United States Patent 10,233,495 (METHODS AND COMPOSITIONS FOR SCREENING AND TREATING DEVELOPMENTAL DISORDERS) - sequence listing, part 167

SEQ ID NO: 1001 - DNA, 1383147 bp, Homo sapiens
aagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtaattttctttattaaaaaatacacattaaagtcttagaatagtttgatatttaccgacaagttgcgaagattttacagagccgtatataccaccctattgctaatattttacactactatagtacatttgtcacaatgaggaataaacgttgtggcacattactattaactaaactccatactttatttaactttattacttttcccctaacctcctgttccaggatcccctctaacacatgacatttagtcattatttctccttagccttctctgaactgtgacaatttttcagactttcttttcgacaaccttggcagttttgagaagtactggtccctgattttgtaggatgtgactcaagtcgattttgtctgatgtttttctcataattagactggggttatgggctttggggaggaaaacttcagaagggatatactattcaattcatatcctaacaagggtctatgctatcaacgtgacttatcactgatgctgttaacctagctcacttggctaagacagtgtttcaggtgtctccactataaaacgctcttccccctgcttcgcacaccatactctctggcagcaatagttggcaccgcctacccttacgtggtggggaattattctctatctccttgagacagggcaagtatcaacataaattatttaaaattcttctattcggatatctgtctcttcctcttctcccaccccctgttgactttattcaatcacatatttattcaatcacttagctcctgcatacttttagcctacacctatcatttttgttttgtaagcatttccttactttctgataccatcataagctccaggatgatcttgtatattccctgccttggccctagaatcagcaatttccccgaggactctggtttctttcattggagaatggtttttgaaaccaagatcttggtgctgggtgtgctggtcactacaggggattcatcgcttctaggccctctcagtggacagagctaggaaatctatatgtgcatactaacccatgtatgtatacatatctataattatttcaatagccatccatctgtgtccatattaaatatttaagcatgagttcacaatgatgtttcctactctagtactgtaccacatggatcattctagtcttcctcctttgcttgtctgtaacctcccatttgaaaactgagaaaattggatctaactcttattggttcatttacttactttttccatccaggtatacatacatgaagagtggcttcaggactggtaagttatgttcctttgaaaaatagctttaccaactagaggacagtgctcatgtgcagttcctttgcccttttatcttctactttccaataatttccaaagttacttaggtcaacagtctttaacccaccctcttcagtgaagttatgttatatacttagcatacagttacatctttttgtcgaagtgtgcatttcatcccaggatctcttaatctactagttattttaaatttgcctatgttaaatttattctctgctctgtaaagttctatgaattttgacaaatacacagtgtcatatattcatcactatggtactgtgtggaatactctcgccaccctaaaagaatctcctgtgcttcacctagtcaactgtctccctccccaaaccccttcaaatctctgatcagttttctgtccatgtatttctgccttttccagaatgtcgtgtgaataagatcatagattatgttgccttttcagataggctttttttcatttagtaatatgcatttaagattcatccacattgtagcatggattaatagctcattctactttattgctaagtaatattatctgtggatgtgtccgtttgtttatccattcaccttctggagaactcggttgctttcagttttgggtgattataaataaaacttctagaaacattcaggtgcaggtttttgtgtggacataaattcaagtcaattgggtaaatacctaaaattgcaacttatgggggatatggtaagtctaaactgtctttcgaagtggctataccattttgcattctgaccagcagtgtgcttcaccagcagtatggatattgtctttttatttttttaagatttcagtcattctaataggcacgtaatggtatcttcttgttttaatttgcagttctctaatgacaaataatgctgagtatctctttatatacttatttgctacctgtatatcttctttggtggggagtctgttcagttattttgcccatttttaactgggttatttattttcttattgttgatttgtaagaggttttctaaagaaatatttcagatacatatcgtttattagatatggttgttgaaaatattttctcctagtctgtggcttatcttttcattttcttaacagtgtccttcacagaacaaaggtttttaattttttattgtatttctatcctctttttgtccatggttatatcctctactatacagagctgttccacttactgttagagcaaatcgtattaatttctgttgccctaaataattgtccattggccgagagctgtggctcatgcctgtagtcccagctacttgtgagtctgaggcgggagaatcgcttgaacccaggaggcagagattgacgtgagccgagatcgtgccactgcactccaccctggatgacagagtgagactccatctcaaaaaaataataaataataaataaataattatccattatattgtattgaaaagagctgctatatatggcatgataccactcattatgttagttttccccgttctccataaaatgaccactgtgtctgtcagagttgtcacacagaagtctctaaccatcttaacacctgagcatgcccaggactggaggggaactattgcgttctgtatagagtacaacaatcatgggcgttggactcagagacctcggttcagattttgctcttaacatttcctggttgtgtgaacgtagaaaagtaacttaagttttctgaactttggccttctcacctataaaatgaagataatatcgtccacgtgtcttaggtgctattagaaggacacatacgaagtgtttagcacagggcctgacggagtgtagcactcagtaaatgttagtgcttacttgcttttcccccttgtgctccacattttctttcagcctcctgatttttcccagtggaactctttaccttgcatccatcatttctattgcaatgcatttctatgccttttcgaggagcttttctattccatctacactgaaaatggctcatcctattgatacaatttccctgctcccagccaatggctgctgcagcacttcctgatatctagatcacaaagtccctgaacaggttagggtagcacatgttaaaaaaacaatattcctgcaagttcacctttctcttacttctcatttccaacctaagatcttttcaatgagcttactctgattgaatataaaaacaatttttaaataattcaacctaaaataatagaagtattttttgcttttattatttgtaattaagttataataattgtacacatttatggagcacagtgtgatattctgatacatgtatgcaatgtgtaatgatcaaatcagagtaattagcgtctccatcacttcaaacatttgccatttctttgagttgggaacattcaaaatctgtttttctaggcatttgaaaacatacaagaaatgttgttaattatagtcacctacagtggtatagaatgttaaaatgtattcctttcatctagctgtgcgttgtgttgttaaccaacctttggctgtgcttccccccacccctacctgcctctggaatcactattccactctctacttctgtgagataaacttggaaagaaataatactattaggatgataatttcccacaaattcatctataaatttattgcaattctaattaaaaatcccatatgatttattatggacctgtcatactaaaacttgtttgggagagaatatgctggagaattgccaagaaatgtatcagaacattctataaagccacaataactaaggcaatctgatattgacaatgtgtattttatcaatggaaaataataacataaacatatatgtatttatgtggtttgttcatatatatgtattgtgtatgcatagttgtgtgtatatatagtatttatatgcatatatttaagcataacaattcaaatcatcatggaaaggatggaccatagcaaagggtctttattacacaatagttgtgagcactggccctggcaccagactgcttgctttgaatctcgactctgtttccgggatttgaatctgtcagagctatgtgaccttaggcaggttgtttaatttcttggagcatggcctcagctttcttttgtgctgaataagaaaataatagtacctaactccaaaagtacttagaagggttaaatgaattaatgtaggtaaggagcatagaataggtgctggcactaagcaccagcgaatgtgaaccattcttattattatcatccataatatagaacgtaagcaattgtctgttcgctttgaaaagtaacccttggcagggcgcgatggctcatgcctgtaatcccagcactttgggaggctgaggtgggtgggtcgcttgaggtcaagagttcaagaccaacatggccaacatgatgaaactgcatctctactaaaaatatagaaaactattagctgggcatggtggcagatgcctatagtcccagctactccggaagcacaaaaattgcttgaacccggaaggcggaagtcacagtgagcaagatagagccactgcctcccagggcgagagaggaagactccatatccaaaaaaaaaaaaaaaggaaacctttagtgactagtttagagccctacactgacaggtgcctatccagttgctgatttcttgtgatgtggatttatttttacttcataaaataaagaggcaaccttacactttgttattaaaatagtaagtggtaaggaaccctttaagggatatggttttaacatattattcaaaataggaattgcaaactcaattgcttagagaggtcagcaagtaaatcaatgtactagactgggtagagcgtgtggtgaaatgaaggccttctagacgcttaagaagacaaccagttttcaacaccacccaattattgccaggcagaaacatgcgtgcacattttttaagatttttattttcatgcaatattttctggcttctaaatgttgacaacaaattcaaagtttgaagcattgtgtggatcaaacaaaatagatgtctagagatcagagttggttcatattgtttgttgcaatctgagacttagaacctcctttaggttacactacccagtctttctcccaacctgtgtaccccaattgtaccttgcacagtgctgcccaggtgataaggaatcaatgcttgttttttgttgaattaacttgattttaattctgaatctttctgattccaatcaatgctttgaattaataatactagctcctggccaggcacggcggctcacgcttgtaatcccagcactttaggaggtttaggtgggtggatagcttgagcccagaatttgagaccagccttggcaacacagagagaccccatctctacaaaacaaaacaaaacaaaacaccacaaaaaaacattagccaggcatggtggtgaagtgctgtagtcccagctacttgagacgctgaggtgggagaatcacatgagcccgggaaggttgaggtagcagtgagctgtgattgcagccactgcacttcagttggtgccacagagtgatacaccatcttagtaataataataatggtaatagtaataaaagtgatagctccctctgttagccatttattttaaatatcaggtgctggtagggtctttacacatatccctctgatcattacaatactccgtaaaggttgcttttctcactttatagatgggaaaactaagaggttcagttacctttctaaggtccaaggctagtagaattagtgatatgacattgtctaggtctgcctttttgagggagtgagatgtcaaaagtagtagcaagaggtccagatccctctagggtgtagtgtttcctggcatcagctaactgggaatactgatcacgtcttgtcctggaaacacatttcattggatgaccttgtcaggcttacaatgcaaaaaaaaaaaaaaaaaaaaaaaattacaggataaaagatgaaagatgtcttccacttacaaatggcaagcgatagctatccaaaggttcatttgtaaatcagttgtttgaaactcggaattcattttcctgcagaaacagttacaaatggtggttatgtttcccctgaggctcatccacaaaagaccatttagccttaatgtatctgaaatagtgtacatttgctgtgaaaatgtgtagaaaatagaactcttgtaattctagtaattaaataaaagaaaaagtaaaattgaatgagaactttaaactgcatcttgaatgctgcttcgaaagaaaagcagatttacccagaagaggatgcagaactttgaaaataattttgtggggattttaaagggggcttctgaatactttcacagcacttgagaagttaatgaaatcatatcattgaaatatcgcatttcatttcgtgatttctagatttttaacataatctttccatgattaatgctatttctagtgttctctttagaacaagaagaagaagggaaaaaagggtggaaaaggaaaagacaaatgaaaatgggcttcctaatgatgcagaagttgacagagatagcatgtgaaagaaaattaaagatcatgtttgtttttcgataggcatgcaagaagcaaaattagccatgaattatgaacagtggaaggaggaaaacatagattctgatttcacttgagagagacaaaacaatgctggtggcagagatcttttctctgagaaattccagaaactgttactgttttattccatcatcttagggcatcatacttcatggcaaatgtaggatgggtacaggattgagatcaagagtgcaaaagttgctcaaatggactaaatgttgagaatactaagtacttattaaacaagagaggatttgttctcaaacaaaagtaattatcattttttattgtctaggttttatcattcatcttgtttaaccttcagccaggagaatgaaagacagaagtttttaaaaaatatatatatattgtgggcggggtgtggtggctcatgcctgtaatcccagcattttgggaggtggaggcaggcagataaccatacaggagtttcagaccaggttggccaacatggcaaaaccccgtgtctactaaaaatacaaaaattagctgggagtggtggtgcatgcctgtaatcctagctagtcaggaggctgaggcaggagaatgccttgaacccaggaggccaaggttgcagtgagctgagattgcaccactgcactccagcctgggtgacagagtgagactccatctcaaaaaaaacaaaaataccaaatatatgtatattgaatggccaaatggttgaacaggaaattgaggaagaatgaacaacctcccagacacttccacagtgagtttgcaaggagcctaaaagctagctgcacagagcagaggcccttcctgccaaatgtaaccttctttagaaatagagaagagaaagacagttgggggacaggggttattatggatacaggacaaaaacaaaccagggtaaagaaaccaaaaaccaacaaggccaaaccaatggacaccttgaggtgatgtgggcagacacagagtgtttccctttgttgttctttggagagtaagataggcttccaccacggaccctcttgtcaataaatcttcctgggttaagtggttagttagactaaattgctcttccaccaatttgagctgacagcagcacagaaccgtcaaaaccattgctgtgttgtctccatagccaaagagtgttgttgatttatttctgttagaggaaaattttaacttgcctacctttattttttttaatcatttgaatttaagacactagttcccagtaggattcactatgacaattttcagtgatgagaaaaagcatcaagggtttctggtctctgaagaattgtgttctttttggccaataaaattaaaatgaaatagatttaaattgtattaattcctaatttaaagctgaagtttcaagtcaccttccattactattgtataggatttctacataaacctattgggacctgagacaggctaagccttactaaatttcctggctacagggatatttcttttggggattggagatgagaaggggtaatatcgacaatctcattttctccttaatttttccttgattgaactggtgtccatttgcttaacttattcactgtgtgttatagaaatttacaagttactttgcaagtgtagctatattcatgtatgtgctatcttttctttcttcaattaaattgtgagctcttttaagtaaggaattatattttatcttctcccacaatgaccaaagccagagtatcttacttaagacacttgaaagtggaatacaaaaagtattttcatgcagtccatactgccttgtttgctaattgctgtacacatgcagacatcatctcaccaactatgccctaagcacctcattggtggagtcttgttttgaggtagtggttgtaacagtttgggtcttttattagtgcattgtagggacagagtagcctctcaacaaatagttgtttgttaaatagtcaagtttggagggcagtagatgagacaaagtagaaaatgagagcttttgcattaaactatgacaactaaaatctatatttaaagtttacaacctaactgtatgttctttttagtacataccacatcattaaaacttgataaataatgtttcctcaatactgttacttaataagtaataaaaatatgatgctggcaataaaagctgttatattgttactgccttacctcctggttggtgagcaaatgctagaaagaaaaaatgggaaatagtttaaatttgagagttttggatcattttcttggcaaagtcaagagaccatttgcttcttttaagcagtctaaaaggtgtcaaaggattagaagcaaaggaaatatcagcattgctgtgctgttagacagattcctagagaatcaaatagggatggtaacaagattgagcaacccatctccttagaattttgcttccctttacaccgacaacctccctattttatttttaattacccatagaaataaacaggaatgctaaaatattttttgaagataaattctataatcatttcaagtttgattgttgataaatatgatatggatgaatataaagagtagattttcaatatgaaaaaagagtctcctaaaatgacgtgggttgtaaattggagatgaatttcttattagttttagtgccttttgtgtctcctattgtcaacttaaatggtctcacacaacacatctgttgctaggctcatgagatggagcagagttcaacaggtacatttcaaggccaggaaggctgataaactgaaggttcagtaggtaagagaagcactagaaacataatgatcagtgaaatttagtactatcaagaggctagaaatccggttagaaaacaaaccacaggattggtaggatctgaaagttgtcacagcttcaacagtcagtattgccaaagaaaataaaatggggcactttttaaaagcagtaaacttcgatttcactcaggaataactattgcaatgtgggagagacctcagcataacagctcagtccaacgaaaggcaggagactgtttaaatgctggggtgtacccaaagaaaggcattaagggagagattggtccatgtgattaggctatctgggtttgctaactagtgttcacctagaggagcaaacttctcatatctttttgacagaaattagtggtgcaagttggagcaaggcatccactgaagttaggtccttactgtcctacagggactgggaatgagaactattgccttgaatgtttgtatttcaaggagatggctctcatgtccttgaggagccacttctggatggtaaaagatttatttcaatgggggcagagaaaggatttataattgcaagctttctaaaataagtgctttaagagggattcaagggcctattggcctatcaccaggttttggctggaacaaacagtaaattctcctggcagcattgagctttctcagaaagtcattttaaggggggttagtgcgagaaagactgaaaaagaagtagtcccagaactgttctcaccttcgatgcaggctgcgtctcagcctaatatttgtcctgatattattatctcaggggactcacagtcaggaagagttggtaaagaggttgtcagactttaatctcccccaacttctagtaacttaccagaagatgccacaaagtttagtggtgatggagacccctctagctagaagaaacttttggtatttgtttttattctatttgtgatgtgttctagcattgtgaaatgaggcaaaaagaaatgctgaagctggttcacagaagtaagttggtgtaaaatcctatgtggtccaggtttatctcaacaatacaatctcctcatgccgttctaccttagccaatctcctcccatcaccatagcaaccacatcttataatatgtgattccaacttagagtgcctcatcactgccctttgtacatgcagattgggaaagatggaagagactgttcttgggaatagcacacagcaatctgggccaaatctgggtggtgtgtgccccactatttgccaagcttattatcattttttttctcctttggccttattcaactagaagtcctctgcatctactagaattcactacatatatagccccaatcttctttcttttatctctggcagtgaacaatagaaggcatttaagagcatgaaaaaataaataataagtgcagtatgaggtgtatggtagccattgctattaaaattactcattcacttttctatgatgaatgaaactctagtgataaataataatggtgcccctgaaaaaattaggtttgcaattaggacaatttctgccttgtagacaaactgcctaatattatgcttcaagacagttatttaccatagttataacccaatgtgtcctgctgaaatggcttgtttttcctacaatgttaaagatttaattttttgaagatcagtttgtttgaaacagcagctgtacttttaggaacataacctgaagaaatgtagatgtagatgtaggttaaagtgagttcatcacaggcaatcgaagatgtagtttaaagatgtagaattgttgatagtagtaaaaattgtgaacagtcccagatattgaaccttagaggactcatgaagttacataaggtaaacacgtgcaatagatacaatgtaacctttaaattgatggtaactgtataatatttttgaaatggaaagatttttatgatacatttttagtgaaagaagtagcttgcaagtaatgtaaacactgacatttagttattaaaagatacatatacatatttgtatatatttatacttacatacatacatacatacatacacacacttatatacatttggctaaacaaaagcttaaaagaatgatttgtaattttgtgaatgcttttgttatttttcgttgttgtttttctgagatagagtctctctctgtcgcccaggctggagtgcagtggcacaatctcggctcactgcaacctccgcctcccaggttcaagctattctcccgcctcagcctcccgagtagctgggattacaggcgtgcaccaccaggcccggctaatattttatatcttcagtagagatagtttgcaccatgttagacagtctggtctcaaactccttacctagtgatccacccgccttggcctcccaaagtgctgggactgtaggcatgagccattgcgcccagccgcttttgctatttgataattattttcctaataaaatcctatactaatggtgtaacaaccaaaataaaaaagaatgaggaacgtaaaattgcagtttgcttttcttattcattatgtcaacaaaaccttagccaaccacactggcccttcttctttttcctggccaagtcaaccctattcctatgaatgataactggagaaaatgtgcccagtgtggggaacaaggatatgttggtgtatacctaccatggtatctttctcaggggactgagtaaatacagggctctgtgcaacacaggaagaattcttaaggggcacctcaaattccaaaattcagatcctttaaagagagagggaaaatcagtactgccctctgacttggagtgagaatataccctgctgtgaagggaagaaggtcatcctaaggtgggaaaaactaaaggtaagtactgtacatatgtctgggacacaactttgaccttgggggagaaacacacccattactgagtagctttgtcctccacttataaggcattggatagatgttcaaaatggggagctgtacctatgaaacttttgaaagtcatggtaggggctatattccagaagggctgcaaaccctaagagatgggtcatctgcattctgagccttgacagtgaactgaaagagtggtcaccctctgaggaacctggaggccttgccatgcatggcgcaggggcttctgtgcatcagctatttgttcttgaagcaatctggtcagcttgaagaatctgaatatcatagagggagaaaggcttctatagagcattaaagcttgtgacctgaattcccaatgtatgcatttgttggtttatcctgaagaagagaacttaaataagatcatccgcacggcacagtttacacacaagcatgttatttttctgttttctctgttgcactcccagatttttaaaaaacacttaccatgatatccttcaggactcacctttcctggcacagaggtttttataataaatagtaatggaatgaatgagtgagggtgctatataatatttaccgatatcctacttttatatatcaggcctcatattatggtgcagggcagcacaatttatacccagttgttattgccatttatattcaaaagtatcaagctttgtcattttgcaaaaatgcttttcagtcttggaatttttatttatttagactggttttctctctctctctgcccctctctctctgtctctgttcttctcttttctcccaggtctaatgtatcagaatcacctgggatgattgttaaaaatgcagaattcagggatccagtgcccagtcataatctctagggctgggatctgaatattaacattttttaaagactgcagctcattctcatggacactaaattttgagaaccatttgtagttaatctatttaaagaatcacagttttatacatcgtccgtctgaaaatgcaaggtatcacctagaaacttttaagacaacttttcctctcctaggaactgtaaaataacaaagtagacaagtggagagtaagggtgatagaggtgggtggatcaataggaactctctttcctgtgagggtaacttgatagtgactaggcggtgcagttggagtgaattgattttgttcaaacaagttttcctgtttctcagagttcacagtgaacatttttttgcaggcttcttgcagtgtgctgtttcacaaaccatcagaggcatttagaagggccagggtttttcttctaaggcttaagaactttaaatctcttgggtggaagtagttttcagtgacttgtttgttcttgtgatataagacatagtaccactaaccccttgaatctatcattcctacttattgctttaaagccaggatagtatcaagttcttgatgtactttactaatcatggctttcattttctaatgtgtatttaatggatatctattcatttatcattcttaagtacagaacactaaagaaagcatactgtaatcagagatgttatcaggctcaattattttagattaactgggtattgttatgacaatactctgtgatatccctatcttcaagtacaaagtaggcaaggaaaaaaatgcacatcaaataaaaagtagttggcaaaactaccttttgatccattttctctctattagaaatatgaatggctctcaaatgttttacaaagattgtacattggacaccaatgaagctgttcaacactaaggcccaaaaaagaaacaaaaaaatatggtggctctttttgagaaacaatgaatttcatgtctttctagtaaaacacactataaaatagttcttcttgtgtttacatttatataatcattgaatcatatgccacagtcctggaaagttcaaacaggaaatagtgcgtatgtgtgagtggggagctactctgtgggactggtgatggcttggtggatattatttttcttttttaatcaaagtttagcaatcatacagaaatatgtaggcaattaccaaactcagtgaaatgtacacagatacccatgcctgtatagtcagcacccagctaaagaaacagaacatgaaaagcaccccagaaaactatccttatgctccctttcaggaactaattcttaaaaccattgtcttgacttctgacatcatagattagtttgcccttaagttctttataaaaattgattctttttttttttgagtcagagtttcactctgttgcccaggctggagtgcagtggcatgatttcggctcactgcaccctctgcctccccagcttcaagcaattctactgcttcagcttcccaagtagctgggattataggtgcgcaccaccacactggctaatttttgtatttttagtagaggcatggtttcaccatgttggacaggcaggtcttgaactcctgacctcaaatgatccaaggccaaggactcccaaagtgctgggattacaggtgtgagccactgcacccagccaaaaatggattcttatatgcactcttttgtgactggcttctttgcaacatgtttgtgagatccatacgtacttttgggtgtacttgtggtttgtttattcccattgcagtatattattgaattttatgaaatactacatatatatttatacacacacatatatacacatatatgtatatatgaaatactgcatatatatttatgcacacatatacacatacatacacatatacatacgtatatacacatttatgtgtgtgtatatatgtatatatatatatgtatattggaggccttggccttggatcatttgaggtcaggagttcaagacctgcctggccaacatggtgaaaccatgcctctactaaaaatacaaaaattagccagtgtggtggtgcgcacctgtaatcccagatactcgggaggctgaggcagtagagtatgtgtgtgtgtatatatatatatacatatatacacatacatatatgtacataaacatgtatgggtatatttatacatacatatgtatatatgtatatgcacatatacatacatatgtgtgtatatatgtatgtacataaatatatgcatgtataaatatatgtatatatgtacatatatgtgtatatatgtacatatgtgtatatatgtacatatatgtgtatatatgtacatatgtgtatatatgtacatatatgtgtgtatatgtatatatgtgtatatatgtacatatatgtgtatatatgtatgtatttctattgatgatagattattgagtaacatctaaatttaggcagctaaaaatactgctgctactcaattcatttcatacagctaatattaccctgaaaacaaaaccacacagacagtataaaaaagctacggataaatacttcttatgacctaaattttcaacaatatgttagcaaattgaataaaaatgtataagaagaattatacagtgtgatcaagtgagatttattccaggtatgaaaagctggcttaacattcaaaaatcaatgcaattcctcttatcaacagggtagggtaggaaaaaatagaagattatatcagtttacctagaaaaataatttaacagaatctgatatttatttactgcaaacatgcaccacaagttaagaatagagagaaatttccttaacttgacaaaaagcatctacaaaaaacctaaaattaacatcttagatgatgaaagactcattattttcctcctaaggtttgtaataaagcaagaatgtattctcaccattcttattggatgcagcattggaagttctagccattgctacaaggaaaaaataaataaggaaggaaggaaggaatgaaggatgaaaggagaaggcatacaaattgtaaagaaaattatctccatttacaaatttcataattacatagaaaatctggagagatctacaaaaaaacttacataacaagtggatgagttcaaaaaatcataggatgcaagatcagcatgcaaaattttattttttataccaactgtgaacatacaacaatcaaaatttgaaataccatgcaagctaaaatttttccaaagaaattgcaatctatttgtgtatacttaataaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattccatgttcatggattgagaagctcaaaatagggaagatgtcaattattcccaagtttctgttttgttttgtttttacacatagacaagcttattctcaaatttatatagaaaggcataaatcttgaattagctaaaaccatcttgaaaaagaaaaatgaaatatgaggaatcattctacctgttttaaggcttactgtataactacaaaaataaaattattgtggtattgatagagagatacatagatcaatgaaaaaatgaaaaaaaaacagaactattcaaatatgccaaactgattgttgataaaggtgcaaatgtagttcaatgtagaaaagatagccttttcaacaaatggttttgcagagatatagaccaatggatcagaacagagccctcagaaataatgccgcatatctacaactatctgatctttgacacacctgacaaaaacaagcaatggggaaaggattccctatttaataaatggtgctgggaaaactggctagccatatatagaaagctgaaactgaaccccttccttacaccttatacaaaagttaattcaagatggttaaagacttaaatgttagacccaaaaccatcaaaaccctagaagaaaacctaggcaataccattcaggacataggcatgggcaaggacttcatgtctaaaacaccaaaagcaatggcaacaaaagccaaaattgacaaatgggatctaattaaactaaagagcttatgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaactccatcaaaaagtgggcgaaggatatgaacagacatttctcaagacatttatgcagccaaaacacaaatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactgtaaactagttcaacccttgtggaagtcagtgtggtgattcctcagggatctagaactagaaataccatttgacccagccatcccgttactgggtatatacccaaaggattataaatcatgctactataaagacacatgcacacgtatgtttattgtggtagtattcacaatagcaaagacttggaaccgacccaaatgtccaacaatgatagactggattaagaaaatgtgacacacatacaccatggaatactatgcagccataaaaaaaggatgagttcatgtcctttgtaggaacatggatgaagctggaaaccatcattctcagcaaactatcgcaaggacaaaaaaccaaacaccacatgttctcactcataggtgggaattgagcaaagagaacacatggacacaggaaggggaacatcacacaccggggactgttgtggggtggggggaggggggagggatagcattgggagatatacctaatgttaaatgacgagttaatgggtgcagcacaccaacatggcacatgtatacatacgtaacaaaccttcacgttgtgcacatgtaccctagaacttaaagtataataataataataaaaagtacaccccccaaaaaacaaaaaaaacaaaaagttttgcagcaagtggacatctatagacaaaaaaggagcctctacttaaacttcttactgtttataaaaatcaacttaaaatgaataatgaacttacatataaaacatataaagcagttaggggaaaaaaaaacaggagaaaatcttcaagatttaccatgagacaaatggtttttagatttgacaccgaaagcatgatccaaaaaaggaacaaatgagaaatgtactacatcaaactaaaaaaaaagtagtagaagtatttgcaaactacgtattcaatgaaggactagtgtctagtatatacatagagctctctaacctcaaaggaaaaagaaaacttcaaatgaacagaagacataaagaaatatttcacccaggactatatacagataacaaataaataaatgaaaaaatctttaacatcattagctattagttaaatgcaaattaaaaccacaataaaatatcatgatacccctatcacaaagcctaaaataaaaatagagacaacaccaaatgctaacaagaatgttgagaaatggaatcattcatagattgataatcaaaatgttaagaggtacagccaccatataactagcaattgtactctttggcatttatcccagagaaatcaaaactcatgttcacacaaaaacctgtacacaatagctttacttaaataattgtggtataaacttatcatggaatactattcaacaatggaaagagatggacaagcaacaacttagatgagtcttcagagaattattctgagtgaaataagccaacccaaaaggttactgtattagtccgttttcacactgctataaagatactacctgagactgggtaatttatttaaaagaaggaggtccaattgattctcagttctgtatagctgagagacccctggaaacttataatcaggcagaaggcaaaggggaagcaagcatgttcttcacaaggagagagagagagagagaagaaggagaagagaggagaagggagaaggaggagaaggaagagaaagagaagaaggagaagagaggaggagaggagagagagagagaggagagaaagaaagagagagagagagaaagagaaagacaacctaggggaaactgccacttttaaaccaccagatctcatgagaactctagcatgagaacagcatggcatgatccagtcacctcccaccaggtcccttcctcaatatgtggagattacaatttgggatgatatttgggtgagaacacagaaccaaaccatattagttacagactgtataattccattaatataacatttaaaaaatgccaatgttttagaaatggagaacacattagagcttgctaggggttagctgtgggggacagagaaagtgaatgtggtgatagaagccttttattatatggaattgattgaatctatttttgcctatttattaaaacatcataaagatagaatgttttgagctatatgccttgtaaattccatcttaagtggaaataacaattatgagaatcaaacgtatcagttatctattgctaagtaaccaccttaaatcttggttgcttaaaacagacatcgtttattactttccgtaagcaaaagtcagtcgggtggttctgatctggaccaaagtcagcagattttggctgggttcatttacatctgcagtcatatttaaacagaggtagactgaagataaaagtatgtcaagaaaagaacacaaaacagccaacagtaattttagtcagattttcttttatggaaaagtcttgtttattgctatttcttttcttgttgacaagcttcagatagagactcttcagctttattttgtcagagattgcttattagccaatgcgtatcttgtactttatatgattactgataaatgtcttgttgagttgtatttgaagtcctggaaaaataaacctcttgctcagtcacctggatccacaataacttcagtcaccaagttcactccttgagtaagcaaagtctccacaacatctgcatatttgtggccacacaagattgattattttaatttagtctgacaacttagcaagtgtaaacaagttaatgaaacaaattattgtgcctatgggtcagttaaacaatgtttggactcgtttttccattttctcaagtagctgtttagtaaacgtgacccaggagttgaataaatgatgtaaatgatatcttaacagaattggttgaatattttgttgtcaccagagccagtcaaaaccccaaaataattaactggaaattagtaagaccctctgacagggccagtatcagtttacttttttttttctcaatattcttcagaatactgaacttggcaacggggtggaagatcaaggagaggtgagtttgtttctgtgaaaaagaagaaaacacagtgtacatctgttccactaggttttcttcctctaccatgtagacagtttgaaaatgttcaatggccatagcattcagcttccctgttaaaacaagtaccataaagtattcatgaataacaaaataatcgtattcttttttttttaatgtaagagaacaagatgctaaccaggaaccacatcgatcctgaaagcgctttttggacaaatcacaagcctgtgattaactacaaagagcttatagaaagccagaactttcaaaataaaaataaaaatgttgacaaagattatcaaagaatactgtgcaatatatatatttttgtcattaaaaaaggagtgctcacgctagctgatccttgaatttcattagaagccaggatggctgcctgtggaatgcagtcctttttctggggcttacaaactggaggacctcgctcaggccttgttaaccagcacatgctgtatattaaataagattcacatttttaaaaatcttgatttctacttcttctgaaaaatctgaatatctgcttctgtgcagtcaacaggcctgcatttgtgtatcgtagaatcatctggagctgagcggtggcactgtcattttgtcatactccccatcagtccctttgaacactggggacaactttactcatttacatgagcttccaagtcactgtagacttttgagtccgagccctttgtgtcactctgagactggaccttatttcttttgaccaaggcagataccactgagggtaatagtgtttgtggaactcaagggagtgactccaactttggagccgctgaactccaataatggcatgcagaggctgtgagcctgttcaatacctaagccaggttcatgtcctggatcgaacttgaggtatctccgacaactctgaatctcctgggatccactctagacttgcgagacttgcaattagatttaagagcacgttgcctttagaatcatggagctcaaagaatcagaatgtaagtggaaactgaggttgagagagcttgaggactttcctgaccttcttgacattaccgagttctgaatggggaattcatttaattaggtgagaagttttgtacctcattaatcagttcttactattattttaatttttgaggtcttaataacagcaagtaaaaacatactttgttttatctgccacgagttagcccacagtaacccagtactgtgctacccaatgtgttaactatgttgttttgtggttttttaatgtaatgttttgtattcattcactgtcctatgattgtatgtatgtcagggccaaggtctagcagcagtggcttcatctaggagtttgctagaaatacagcctctctcatcccacaccagaactcttcaacaggaatctcgaacaatatccctgggtgattcatatagtgttcattagactttgaaagacattgacatatatacaatcatataatacttaaatgaatatatagcataatataaaaggactacaaaataacatagttaacaattcaaatgtcttcaggtatagaggtttttgcagctacttccatgcttcagcacagaatggtatggtatttttctgtttatttcattgggctgcttctaagattttttttttttttgaagaacgggtttcaaaggttaaaaaatacaaaacaagttaaaaacaacctgttattttactagcacaaactgaggagagaaactagaggaataaggttgaattagctagacaaagctctgtggagtgggttggtaaatttgaatggcctttgttgatattgagaggcacaagctggccatgaggtctaattggaattataacttgaatcctaaagagcttgcattgttgtcgttgtcaaaagacaaaattacaacaaacttagttatagttctttcttactcacagttcatgaatcaggacagctgccgttctacaaaatagaatgagagctcccactgggcactggcagagcggtgggttttgtaaggtggggacaaagaaatgaagcaacagtaaaaagctgactggttaatgttaagttaatttttaaatgaaggttaaatcagagaggatccacttattacactgactcagggagcctgaaatctcctattttcaggaaaaactgttttttttttttttgcggggaggggatctatctgcttccttaatgtttcagtttgattatgtgtcattcagcatgagtcactccattttggtttgcactagtgttgtgcactagtgttgcactagtgttgtggcctaatgtaggaactcagtccaaagcaatagcctctcatgatctttgattaacaggtctttattgtgtctcttctggcgtgtctgggctcctctcttcttcagctatctcctcccctatctcctcctccttttcttttcccttgccttattcttctgtgttgtcctgccttgcattactaaactctcaatcctacgtgcctgaccaaagagctgatcatgttaacccacaattatctgaacttccaccaagggaaagcatatataccctaggattagagatgggaaacgtgcctgagatgaaaatatttaagtaaggaagaagggttggggctagggttctcctactttgttccgcactacccacacacatgtagttaaagttaaaaaggttgcttgtactctctgatacaatttgggagaacattgaacttactggaagattcgttagtgccacattcagtcaccaggttaggcatagaaggaacagggccttaatattaatacattgattatttcctatgttaagaaattctggaaattcaacgctgtagtactgccatcctgtgtagatcagactgactaggccgggatttccaaaagtatacttttatgagtgcgtgtgatgttgatacagcatggtattgtacactgcatttcaatttcttttcatatcatttggggacatccatatgggtcttgttgaaaaaaaaattacatttccttgtggccaaattacaagaaaaataaaatacaaagttttaggtaagatattaaatagatattaaatattgagtttatataaaacatccaaataattttttaataatattttaataagcttcattttatgagaatactgttttgtataaggttttcttgcttgaacagctacaagtaatttttgaagaaggcaatttaatggtgatcccttttaattctttattatcacaaatagcattggatataaggagtgtgtatattactgttttcttcatttgactgcttctttcttgctagcaaccagaatttagtttctataaattataggtcaaaggacttgtagttctgtaactctcatgattttgatttgttttttttcttttcagtgaaactataatgttgaaaatatttgtgataatgcatgcatatggatttatcagttttttatattgttttccaaaaataatgatgatgcttttcttcaattatagtcagatattgttcttctagtgttaaaaattttctttcagaattcaaataaaatgctggtttaacataaccaatcaaccatttcaatctccctttttaaagttgagtttttctgaatccataaatttggtcattaaatattaacataattttacatgttgcaatttacattttgcataattcacattcttgcaaatttcagctaagttcattccagtgctaaaaaaatgagaagtcgatttttgaaagcaaagttgaaaagtactttggatctagtgatagtgttgtgctttcataactagcctcttgaactccagctaatactgttgtaaataccttatagaaaatttttgttccatatcttgcccttgcacacatttaaagttcaaatatttcctgtacggatagttgcttttgacaaggtaccagtgtagtatgtgacaatttgtttaatacctttgcatgcaaataaataataagtttggaagaaaaaggaagtatcagggcccacaaatagacatttgagagaatcctcatgttgctctttagtcctgtcagcttctgtggtggattcttcatttgtgttataaatctggtgacttcaattttaatacactcttcctaattgtggtgggaaaataaatgtcaagtaaaaattaaatctgtttaagcataaagttctcaacagaaatgacaatctttacaaatttagcaaattaattttctgattattagactattaagtttcagttaattgaacaattaaaaatgtttaacctttataaaatgtgattttaaattttaaaggcctacagtgtctttaataaatcaatttaaatgaattaggctcaattatttttatgagaaataaaaatttgctgaaacaaacaataatcagtataaaattccctcaaacccactctggctaattttaaatatcagaagctgataaaaacataagtaaatccagaggttttagtctagaaaattaacaacacccgttatcttctaaatatcaatatctaaaaagaaaaatgagaaacagcaacagcaatcggaagtgatttctagatgagtaatcacaaagataagcacgttaaagggaaagaacaggaaataacttacatgcactaacaaacagaaaacgtttattgaaaagtaaatcacagagcagtggaggtgattgaacaggtagatgctgtgttttattccaataaagtcttcatctgctgaagtaataattgtcaaattcagaaagttacatacaaatagtgttcgaatgtaatttcaactatttaaattttggaataattgcaaaaatggctttaaattttatcacctcacacatttgacagctatcaatatgtcagggcccacctgtgcctcatttgttgcccctggctgagttactctggcctagtggggaagcaacgggacaggggtgtgggacttcctgggtttgaagctaggctccatggcttatttgttaggtgatctcaagtaagttactttgtgcctcagtttctttatctgtaacgtgatgataatagcctactacacttttggctggcatgaggattaagtgaggacacatatttcatccctgaacaatgtctaatgtagagtatgttctcaactagggtggctcattttgatccctactaccactagtaatagtaatccatgaaaatagggcctgtggtcaaatgataaatgttgaattagggcaaaagtaagcagctgttctaattacagaattatagtacttaatatccttctaatatgcattgtgaatctctgagcggtggcagagccatagtgtatagtgttttctaaatttacatagccgtacgataattattttggcccaaggatctcatgtggacactgctgtgcagaagacattttggaaaacaccagcctcgtggcatccccagactaaatgagcctctgcaacatccttttaataagaaggtcctttccaaagtccagtcccagccctggcccagatcctcctatttggaagcataggcttatgctctgtgtcaaggctgatttatcagatggtaaagcttgatagaactataataaacactcttcttgatcatgctaagtaattttaaatcatctaacactttaaatcagcctcagatttttcttgcttctttgaagacctctgccagagagaacatttggagcactggctccctcagacaccctttgggttgcatgtgaatatttccatcgtatttgaatctgttttcaaaataaagcctgattagaaactactttaaatgtctgaccagagtccaaacaccctcagaagtctttgtgaaatgtcatccatgcccggatcccttatgtatttataatattcctgctgtatctttttcccctgcactgttatgttttagatattcatccccttcttctctccaggaaggagtgtgcaactaatattaaacacagagacagccttcctgagcagctgccaacagatgcacagcccttgggccaagttcagctgtcaaacagccctggcccatgaaacaaagggcagaagcttcccaaccacatgcggatgagcagaaacagctgcatttgctgtagccaggggcccagcatccaattcctgtgattcttaataaaaaaataccaagcacatggaaagggaaaattaaatactattctgacaaataccataattgctaacatcatctcccaggaaggcagcatggcagataacccctattcatgagcctttgtcccattgcgacaatcagtgctcaacacactgcattttagctttttactcagtcaatggcctggcaagagaattgtctttttttccctggagcttgaaaatggagtatatgaatttgggagcatatgaagttggtaggactagctcctggaggtaaaagtacctcagattatacataacaagtgattatatttcaatcagcaacatctaccgtaaaatacataagcctaggggcacttaagaaagcatataaacctgggtttgaatatggtggtagcactcagctgtgtccttcagcaagtttgttaacccatcagagagttagttctctcaactgtgaactgggctgatgtgaagattgaaagaaataatacctgtaaaacccttaacaaatgtctgaatacagtgaaagctcaataggtgttatttttattatatatctatttgctggtccaataatttttataagaccagtatgacttctccaccagagactgaccaggaaagaatgccttctgaatgacctctcttgcagcaatagcacggtaggacctatgttttcctcgaagggttaatttctcattctctggctatgtctagcactaacagttccattagagaatctcttgccctcatgatcttgttctgcatctggtaagctccccacatttgttcccctcttcacatgtcttttgcaaaatgagctttctattggtggttggctctgccccacactttcttgcctttataactctgtgtaggcattttccattctacttcctacttccatcagctatagaaggcccaacacccatttcagctctactccactctagcacagtaattgtagcaggggttttcctaatttccttgagggaagaaggagagagaaagcagaggcaggtaaagggcccttgagagggctccctcacgagctccacacctgtaatcaatgccagaagactcaatgcacattcagaggccaccggtgtagactggaggcagccgagaaagactttgtggaggaggcaagatttgaagaattgatagaacttggcttatggagaagcaaagggggagaagagggagaaggtgaggagaaacaattcctgagtattagaaaaaggtctgaatttggagctttaagatctaggtttgtgatcttgggcaaggtacctaaaaactctgaattttagttaatccatgatgtatatatgggggcggggggtaatgtgaactcagaaaacttgtgtgagaaggtgcttaaaaattagttgaattgaattttatagaagagacactagtagacgtatttagttgtaagatttttattgtgatattaatgctgccacgctaatagggtttaaagatgtagttgaatcctgttataaaacaagcatcatgtcagatccataattagcattaaagtattcattgagtgcccattatgccctggcaagctcatacctcaaaattgtgttcttttacttacatatgatttatactagggtgttttatgactttcaaagaaatttgccttatcaaggaaaccaattatacctgatggactcctgcatactcatgtttttcaatttaaaattatctttgattctactgatgatcagaaaatttgtgaaaattttagaaagtccaaacttttaaagtttggaaaatacaatgaagaaataaaaaatcagaatgaactgtttcctactcaaattttcattcataacataatctttggaatattattaatggatttatattattccaaagtgtgggtatcttgtaatttatgaatatctcatctgttccaagcttttgctattgtaattaaacttgcaatggatatcctttgtataaaaatcagtctataattacttcctttctttgcatctccatgaagggaggagaatgtttcttcctcatttataggctcaacagcccaacttgaccctccagtttgtcacacacatcttttctgcaggataagaaatatcagtttccttgcacactagcagaagtggttcatttccactggaaacttaccagaggcattctccaccagatactgcatttccttaggaaaagttttacctattttgctgagaagattttactcactgaagcataaaaatacatgctctcaagatgaatacatgtcaggtaagttctagaaggattaattttcagttatttaattctggaatttaattagatcaccttggaaggcaaatttaaagaacattcttagacaaggtattcataattcgaaaaggattttcctaagaactgataagcatggtggtgtctttccctttagtgctttttcctgggggcatttagaattcatggaaaacagttgtcaaacctcaaaaaatggactaatgaatgaatataagctcaaaaaatggactaatgaatgaatataagcttttactcaagaattaggaaggattaacatccttttgctcattctgtgaccagatgtcttgtatagggttatatatatttcatttctgtttctctggttaagggcatcagttgaaagtgtttgttacagctgaattgacttgtgcattcatactctaaatattattttaaaatatctaattaatatattattcaccgagcgactcttttttagtagaagctatcacatcagaaactctttattctgacaaagtgacatattgtataattttattcccaaagctaatttttttattttaagacatttcatgagatgttaaaagcccctagtgaagactgttaaatgagccattaaggttaggttatcaatgatcaactaaccaaactatcttaattttcttttgattgaataatagtaacagcaacggtaggaacacacatatgtgcaactaaaaaataaataaaagtaaggacaaactaaaaaataagaattatgcaatgggcattatttaactttgaaaatgtcctataagatttcaagggaaaaagtaaataaaatgtatatgcacgtgcttacattttctggaaacttctgggagcaactattttgcatttcaatatatttttatttaatataaaactaaaaagttgtcttaaatagaagttaaaagcagtttgctttccatacgcaattcattatatcaaattggatagtgttcttggctcagtcagcagcagcagcagcaacattgagtgcccttgggtgtggctctgtattagggtacagctagtaaaattgtcatttgagatagagaaatagtgtcatctcttaagaaatatgctattttcatttaacaaatgtttgttgggcatctataagctgtccagatgccatgctaagcactggggacacaggtatgagcagcatatacatgatcctggctttccagcccttaggttctagtggacactaagacaagcacacaggtactatgagaaatagtagaaagctcctgtgctccaggaaattagaactgaaaacagtttgtagtgccaagtagacaggtggaaaatatgtgtttaataaggaattagcataaaatatagagatacactcagtgtgcattcctatacattcaaatacaggaatgcacagtggcagcaaagtgtggtggtgagcagatgaactctgggcacaaattgcccagtttcaatcccggctccactattcctataaggtaagtggagcaagttaccttttgctctggaagccaggacagggatggtgggcagagagagaaagggccagagagcgggaagtgaggactgctggagtataattaaagcaaagcaggtatagtggttccaagaagaaaaatttctttcaagaagaaaaatccagaagaatggcttgtgcagcaggtggcgtcacacagcatgtaagagagggacttactttaatgctggtaggaaccggtaagaggacatagaaacccagaaagataagggtacttgctcgaatctctcaaccaacaagttcagaaatctcatgtaggacgtggtgaggtttatcaaaatggggcatgggatgcaatgaagtagcagagacactcaataatttcgacttggaagactggaggattcattaccataaaaaaactgaacatgggaaatgaattataataaaaatataatgactgggtgtttagtttgaataaagaatagaacatcactgtgtaataatcgctgagaggtttacaggtcaaatggaagattgttctgcaagagaaaagaaaggtaaacactgcaagcaactacaggccatgaacgatggtaaaatcgatgtgggagacagagcactgaactgggagtcaggatacctggcctctactgaatttttagcaaataacagacttttcctgcaccctagtttcctcatctgtaggcattacataaacaaatattttcatttatgtttctgtgagctcaagaacattgcctggtatttcatattattaagtgcttaattttctattttagtgaaagtatgctgcaagaatttagagacagtggcaggtaaataaagacagcaataaggcaaaaaaaaaaaaaaaaaaaacccagcaaattgtcaataaaaacagtagttaaaagctgatttctggaggcagactgcctgagttcagatcctggctctctgcagtgtgatcttgggcaagttactcaacttcttctgcctcattttcctcatttataaaatgggaataataatattatcttcctcatagtatttgtggaaagattaaacaagttaatatctataaagctgcttagagcagagccttttacatagggagtgtgcaaaattgctattaagcttcactgaggagatgaaactcacttgagctggatattaaagagagaaaggtttggagagatatttcaggccagggaagcagcatgtgaaaaggaagaagcaagcatgagtttgacagttgtgcatggaagataatcgtgtcactttctaggggagaaagaaaccaggatgaataatggagagcatttatttctagtacagaggttcctgctacaaggattaggaaatccggtcatacctacattgtgcctatctctgtaaagagacaatgggacaatactggaggttttcaaaagggagtgacataccatggctttggagtagctgggtctgataggcacattctgattgagtatacattactgaggtcatttggccagggttttctgcaagagtaaggcaaaagataatgaatatttttagaaaatagtagtttcaacatactccaaaaggtttggtattagtgatagaatgggccagggtttaagccatgaaagaaaagccttctctttgggccttttcatctaaattacaggtggtattggggtccctggagagagttcattttgtagtgaaatgctatgttttgtgtggagaagttttctatcagcgcttttgtgaaatttggaggtctttaaaaaaatctgtctaagtaaatggtaactaggtaatttgggagaggaacaagtatagtaatctcactgaaaaagttacagttttatttgctaaggattatagaaatagtaaaaaaaatgtgaacgttttcatgggctattacatgtatgtctttgttataaaattttattgcttaaaagatgtcctcatccacagccatgtcacctgagcctgtgcagtgctagtatttgagcagatgctgagttttcattttgcttcaaagtccattaattcagaactctttaagagtgcctttaaaagttcaaccacatttaactcatcttatctacctttgcatttcccatcccagttgactaaagttttttatactataagtgatcacatgttaagtaagatctgtaaatactgctttagctctgggaaattgtttgaaagcactttaaaacatggagtctttctccattattgtatttctttctgtatttattgcctatcatcttaaaaaaatctgaaaactgaagctatgacaaaataatgaatttgaacatatcacaagttgataactaagataaagaatgttcttttataagacattgcaaagggaggttttatcctctgtaagtatgccaaaagaatctacttggtctcaggtgttgccattggatgtcaacagtgataggccatttaaagataaggccataaactgatatctagagaacttttgattaattagcagctggaggataaatgcaaagaagcttcttgagtgtctagatagactaaagtttgctggatgaggtagatagagacatccttctggtggtttctctattgtctgagaagcaaatgctaactgaatatatagatagacattacacacacacagaaatttttaccttctctcttttcacaaccttgctattgccctttggcaatttcttcttcctttatattggacaagactgatcctgatatcatttgtattagtcagtgtccagtcaggaaaatataaaccatatcagatattttaacagaggaaagttattagaggaaattggccaaacaagtactgaaggactagatttgagattttacagagctagttatgaaggaagcagctaccacttctaaagtggtggtggggtgggagtggggcagggagagaagatgtttggggttcttaggatgaagaaacctggaaaaggtgcctgtgaaactgaagtccagacctttggatggaggggctctgtttagctggtagcactatatcagaagctcagagaagggacactacagaattggggcctacacctctaatgagagtgttgcttatactattttggggatgctgcaacaaaataccttagactgggtatcttgtaaataaggaaattatttcttacagttctgaaggctgagaagtccaagatacaggtgtcagcagattcagtgtctggtgaagatctgactcctggtttgtagatgactgttttcttgtgtcctcataaggtagaagtgcaagaagtctctctcgggcctcttttatgagggcactaatcccattcataagggctccatcctcatgatctaatcacctcccaaaggccccacctcctgatatcttcaccttggagggttttgaacatatgaaacttaaactctggattttggagagacacaaatatttagaccatagcagggtactttgccaccacttcaactatctatgaggggtcacaatgaggctggtttgggaacactcaatgagacgcaggaaatggaaccaactgctattgccaggatgaaaggccattgttgaggtgacacctgcaggaatgtgagcaaaactggaagaaacaagtcctttgtttctcctccagcctctaataggttaattacagcacaagaattttaactaagcgttactgttatcaaagcatgctgatagaaggaccttggagaccctctcaccatacacagacatatatatatataatatgtatatatgtgtgtatatatacatatatatgcatacacatacatatatacatacacatatacatatacatgtacatgtacatgtgtacatgtacgtatacatgcacacgtgtatacatgtaggtatacacgtgtatacatgtaggtgtacacgtgtatacatgtgtacgtgtatacatgtgtatgcatgtgtacatatacgtgtgtatgcatgtacgtgcgtatacatgtgtatgcatgtacgtgtgtatacatgtacatgtatacgtgtatacatgtacatgtatacgtgtatacatgtacatgtatacgtgtatacatgtacatatacatacacatgtacatatacatacacatgtacatatacatatacatacacatacatatacatatacacatacatatgcatctatatatatatgcatatatatagatgcatctattttatagatgcatctaagaatagggtcagtggtgaaccataaactagaatgatgagtatgattcaggaaaaaaaaccaaaaactaacatcactcttgttcccattatgggtctataattttattaagttattcagagatagcatctcagttaataattctcatttaataatcccaacagccttgttagagaagtgggataatttccatatcgaaaatgaaaacaatcagactcagaggatttaagtaatttcagtcagtcagtaagtagcggataggattctggccaaggtctgtttaacaacaaaggacatgtttgaactctcatccccttcaatggaaaataaggcaaagccaagaagccaaaagtacaggcacccaacaaagtgggaggcacagaacaagggggagggcaggtatgaacatccagagcgactttgattctagggagatgctcactcgtctacggaaggtgtattgtattcagtttctgtacttccggtcttcactctagccttgccttctggattgttctaccaagtactttggcttttctcatagtctttcaaaaattgttaatattattttgattgaccagtcataattgtacacatttaaggggtacaatatgatactgtgatatatgtatacaatatgaaattattaaatcaagctaattaacatatccatcactccaactacctatcattttttatggtaggacatttgaaatttactctcattttgaaatgtgcaacacattgctgactatagtcaccctaatgggcaatagatctcaaaacttattcttctgcctgtcctatttgaaacttggtaccctttgaacaacagctccctacttcctccctccccctcccctgccaggctttggtaaccatcattctattctctacttctgtaagtttaatgttttaagattccacatataactgagatctcaaacaaactcaaatcagtatgtcaaaggaatatcttctgtcttagtctgttttctgctgctacaacagaataccacaaactacgtaatttatagagaaaagagatgtatttggctcacagttctgcaggctgggaagtccaaggtatgatgcccatatcgggttggcctggggaggttgttcttgttgcattgtcctttggtggaaagcaactgagcatgtgagacagggaggaaattgggccaaactaattattttattaggagcctatttctgtgataactaatcccatgataatgacattagtccattcaggagggtagagccctagtgacccaatcatcacctaaaggtcctacctctcaacattgttaagattacagttaaatttcaacataagtttcagaggagacactgaagacacagcatctgcattcccatgtccatgtagctattcacaatagtcaagacatggaaccaaccttaagtgtccatcaatggatgaatggataaagaaaatgtgttatacatatgcaatggaatactattccgctttaaagaataagaaaatctattatctagcacaacatttatagatctggaggacaacatgctgaatgagataagccaggaacagaaagacaaatcccatagtcctgaagtcaaatttttgctgccacaaactgacgcgtccatggtggcagctatccctgatctctcatgctattcatgggtatgatacaacagtggccaacttcattctcatgcttttcacttcttgcctcccaccttgggggttttcaatgactgcttagatatgagacaccagggcacatgctcactcctcatgcatgtgtaatccagaaagggcagggagttaacaccctttggagtgaactttgagcaagggctgttagaatgtgtagatgcatttttctcccttcctctccctggatgaactcttcacatttataataacgtcagttggcctctttgaagatgtcctgcaaggctaggcaaacagcttcgctaagctggacaactctatagtacactccattatatttgtttccccttacactccttttccttcacttctgctgttttgggactgcgccatctcccaataaaatgttagcacaagatgcttttgcaaaggcttttttttttttctgggttaagagcagggactgggctgtgaaggagagccataggctaagatgataggacccacaattttcttagtgtctggtagtaatcccaggtatccatcagttcaggaaggtaggtagaaactataagtagattaaaacagggtagcaagaaggacttctgaaaaagtagtgagaatagatctgacagcttccacctttatggaatgaaagcttcatcctgtagattggttcttgtgatgcttatttaaaataaatttccttaaatgaggcccaacatgaaccaattctccacccctgtgaaaattttctattgccagtttgaacttctatgggtgatcatacaatcgcatagcttctgaggagctaactttcactcagaacttaggattcatctgttgtcacctcctctggggagaactcactggcccctctcctttctgccagctgttgagaatattagggttccctcttctgtgtttcagaggtattttctcatttctatcgtggcacattttatgctgtttctgcacaatgcagagagatcctgaaagcagagaatatgccttagccactgctgaatttctagaaactaacagaagcctgccacacagtagccatttaacatggattgattccattgactaaattaaagaattcatgaggagctctgatcatggcctgaggtttgcagttaccctattgaacaaatcccagaagagaatttgcggaattaggtctacatgtaatacacatttacccacatgatgaaataagatgacaagagctttgtggtatcaaaatatctatgtctctgacaattttcacaactttacttaattatattagggttaagtattggaaagccttgatacaatgctaatttggaagcattataccaaagtgttagatcagattagccccagttctcttctaaatagttccagaaaccagatttggacccagtcagcctaacggcagtaaaaaccaagacctgtctatcatgctacactgctttcttcagatgacaggggccttaagagcaaagtaagatattgattggcctccaggatccaggaaaaacaaaacaaaacaaaacaaaaaagccagaaagaatacaaggtgaaggcaagactgaaaggaaaatagttttgatgtactaggaaacaaaatcattgaatctgaaacactgttgtctttggaatatcctgagagaaaggagcccaacacaggtcatttggctggaaggaagatcaaggcaggagtccgtctggtgcgtggggttctccatgggagactgtcaacagctaagggcagcggagggcaatgatgaatgcctcagagccgagggccacagaaaaggcactgggaacactttccatgcacttcatacctatgactgagaggatggcctaggcaacctgctttagggtggaaactatagttacaaagatgagcagtcacttaatttactaatgaatgaccccaggtctcatagcttttctttaggaaggattatatagtagttaaaaagtgcatggttcccagatatagaaaaatctgggtattcaccttggctgtaccatttactgtgtgaacatctcaggctactatctttacctccatttgtctcagctggcacctccttaaagcaaaaataataatattacttcagagggttattgtggacattagagaaatatatgtgaaacacctgtccaagtagcaatggtgagtgtgcaatgaatactagttgtttatcatgtgattattagtctaattcttgcaaaatgtcccagcctttgtgttttgatgaacaagaatatatttttaaaaaattaaaaaattttgttgtcctcataatatagacatctgctccctgggacctaaaaagcaatccataattttccaaagctgctaaaaaatctgccatgttctaaatgacctttatcaagcgatctcctagtctagagaggcggaggagtaacttgaaggtgaaataccccgttagcaatcccccaggtgaatagaaaatttaaaataatattctaatgattcattgtacattactacgccccattaggtgtctacattacatcttggggcacaatcaatatctgtcatcctgcttatggttttggtgctagagcggttcaatttcattttgcaactctcatgctcatgaagctgtatctcgggtgtcatatgataaaatattactcagaagtacgtattcagtcctaaagcatagtgggaaataattgatgaagaaagtgtctttccatctggtcaaacaccattaaagtgaggatacgatttatatgagaaaaaacgaagattgatattccttttttttttttttttttttgagacagagtctcaatccatcccctaggctggagtgtagtggtgcaatcttggctcactgcaacctctgcctcctgggttcaagtggttctcctgctttagcctcccgagtagctgggattacaggcacgcaccaccacgctcagctaatttttgtatttattttatttattttatttttttagtagagacggggtttatcatattggccaggctggtcttgaactcctgaccttatgatctgcctgccttggcctcccaaagtgctgggataacaggcgtgagccactgcacccagccaaaagactgatattttatgaaactttttggtaaatccacgtgagagagaaagtttttattctgtactcaacatagttccattacaagcatttttcaaacatttaaactggattgctacttacaaaattttaatatagacaagactagttcatgaacatatcccctttataaatacaggtaccagtacgtagacatatatttcttgtatttaaaatttaaaaaatcatactacattttagaatatggcaaagcttaagagattccaaaacagtcatggataagtaataagtcacttgtcattgttctatacaaaattaatgaatgagttaagtaacctatgttttgagctgtttcctttcagaattgaaatgccaaaggagtgaccctctttttctcatgtgggtgcacacaagcatactccaatcgaaatatcttccccacacattctaccatgtggtagtacctagtaagtactaacctactcactaggttagtagagacttgtattagaattcagacatccttgggagggttaaacccacgatcaagtgactcatactttcacatgaatttttgaaaactttaaatgtatgatttctatgcaaattgagatcagactaagtgtgaattctacttaaaagagaggatttcggagtactgtggaataggacatgccaaggcccttgccacagcttgagacagacagaagatgacataaaagtgcgtgtgtgtctgtgcaagtgtgcgtgtgcatatgtgtgaagtataaagggcccatggagggctatagagatagatggataagagttgaaaaatggatttaacttggactgctcttctgttcaagatgcttttggctgctgcaccctttgcaatggctctggaaaatcaccaatagcatggggcttcatgcacagatgctctaagtgctactcgacttacccaactttataaaaggagggatgtgcacagctagtacatctgtgatatttgctttgggatcagaaatactaagtgggacagtggttttctttgatatagggagatgttcaccttaaaaatgactggaaaagtggcttgatttggtcttcaatatctaatcatgaaatggatatactttataaccagggtatatagtttgggagttttgactgattataatttatgtcatttcttttaaaaggttgagagattcaaatgccttgatactgatatatcaatgacacgttggagatgcattttttgggttttagcatactgaagtgaaagtcagtcaatagaatatacattgattccagggtaaatgtcccaaatttgagaaaagaggttatcctgaaaggggagaaattatctcacggtcccaaacaatatgttgtttcattacactgtttgtgggacaagaagggaagggggttggatgcaggattaagacaagtgaaactgtcacatagaaacatgaactctggttgggacaatctcaaaatgctgcaggtgtttgtaaagcttgctgagattgactgggctctcctattacttacttttgatgctggattttgtctgacttttgtcccataaaaaataagacactagaaaggctttttggtttttataattattcatcagtttctattttcacatagctttggagcactgtagaggatcccttgtatattttagaatgcctatgtgggggaaagaatcacaagtagtaaagagcttaccttgatttttggaatagatatgttttaaccaagtgtagtaaagtgaatattctactttctagtcatttgttacagaatcaggcactactacctccctactgtcacagtaagtagctgtagtctttctataacttaggactggtgtggggtgatttttgatgggtaaattttcaacattcttatttcagtcctgaattttagaattttgttgacatacacaggattcttcaatagccttctatttagtcttctatttgccacttcttatttccaactcatcttatatgttactatgagacaaatgttcattaaacattacttttgtttgtttttgagcaattgcttcttgaagtgccagttttctattgctcttgtgtataatccacttttctctttctggatttgaaggtcatcctcagttttgctccacttgatctcatgttaacttcctgcccctccttatcatgaaaagtactccagcctgcaactaagcccttctcctcaccctctatcgttgtctctatgcctgccttatgctattgcttttcccaagagtacccaccccaccctcttcttcctcctttttataccttactgagctttaagtttcaccttaatttctacctgtataataacaaagtagcttgcattcattgagactccacaataggccagccactattctcaacacatgtcatgtatatgttgttaaatgttgatatcaccctattggggaagattcttcctctaccctctaagggtctctggcagtacctaagaattaaattaaactgaggtggctgggcgtggtggctcatgcctgtaatcccagtgctttgggaggctgaggcaggcagatcacaaggtcagaagttcgagaccagactggccaatatggcaaaaccccatttctactaaaaatataaaaattagccgggcatggtggcgggtgcctatagtcccagctactcgggaggctgactcaggagaatcgcttgaaccggggaggcagaggttgcagtgagccaacatcgcgccactgcactccagcctgggcaacagagtgagactctgtctcaaaaaaaaaaaaaaaaaaaaaaaaagaaggaaactgaggtaacacagatcaacaggagaatatcatacacaatttgctaaaattttacatatatgtggaagtccttacaaaacaaaataaaaaaatatagacccaaagaagtgaccaaaacagatagcttatataccttttagacaaagaaaggataaatttttaaagaaatgataagacaaagggatttgggctaggagcaataaattgtagggaagtaactaacagatatattggggaaaactagtagaagataaaggttattttagcaagcttgtttgaacagattcatttcagcattgattcccagtctctggtgattagagtgttcctcttttcttggtacagggagagcacctttctcaaatgaaatttatgtgtttttttttttaatggcccatttttaggtagcaaaggggaggtcagagaccccttcctgcatctgctgttcctcaagtatctccaactcaaaataatcaatatgcccaaatagcatattttgaggtggcatgtcctgaactccttcaaactgtataaggtagttctacatctccattttacaaataatggcatcaaggcacaaaggaataaactcactaagggacacagttgtgaagtcactccgctgggacacaaagccagctgcctgccccacaccctgttctctctgccactctgctgcccttcccttcagtcttctcggactctccagctcattctgctttcctctatctatgaacttatatggtagctgttttcaaaaccgtacagtttatcatttcattgtgacgagttcatgcatgttagttttttctgagcaattacatagcaagatatcttgaaatgatttctatgcctcattctactttctttccaaagcagtcctggctcctggtaagaactcattaaatactttgtgattgatagataatacaaataatagagataggaggcaggggaattctgggcagaagaaggcaggtccccggcaagggccccaacctcaagcctgaaaccacagcccaaagtgagaacatacatacctgttttcccactcaaatgttgccttttccaaaaccacccatggcctgtcccactcccaatcctgtgcccataaaaaccccagaactcagccagcagagaggagaagcagctggatgtggaagactatggttagatgtcagagagaagtgacttgacttcagagggacagcttgatggcatagctttggagaggaatccggccgttcctcctccatcccctttccagctccccttcctgctgagagccactttcatcggtaataaaatcccctgcacttaccatctccaatttgttcctgtgaccttattcctcctggatgccagacaagaatttaggtgccatgagtgcgggtacaaaaggctgtcacactgaccttccactgagcttttaacacttaagccatccagccatccacagatggcaaagttgaaagggcactgtaacactccttctagggcttcaggtgttgcaggcacccccctagatgctgctgtggggtctgcacaaagttttgctcctgccggcacccaaaaacactcatcctggctcccgtgtccactcacctgctctccccctcccacaaaaggtggaacacaactgggccaagcaagtggagtctgaccctgccagcaccaaaggagccagctagcctgtgaaggcatcagggaagtatcatgcttcacaaagacagctctcctcccctcctatgatacaaacaattgtattgatttttgtaattcactctgactatatagaccaagtgccttcaagcacggtgacatactaaaaagtatacatttcatgtgactgatctacaaagtagccctcagcttagctgagagttgactagcatcctgcaatggtttctgagttgggctccagtgggtctgaattattcagttttcttttttttctttttttttctttttttttttttttgagacagggtctcactctgttgcccaggctggagtacagtggtgtgatcttggctcactgcagcctccacctcctgggctcaagtgataatcccgcctcagcctctcgaatagctgagactacaggcatgcactacaacaccccaggtaatttttgtagtttttgtagagacagagttttaccgtgttgtcccggctggcctcaaattcctgggctcaagccatccacatgcctcagcctcctaaagtgctggcattacacgtgtgaatcactatggccagccttcagttttcatttgcattgttctgaaacaattttttaacattccatgttatacaaacatcacacaaacaagaagattacaccatttgtgatacgtacgtggttatagttcacataataggagacactattcaactaccttaaaatcagcttactgagcaccagaaacaacatgattcatatattggcttaaaagtccagtatcactgtgattttcctgattttttctttttttaaaaaaaaccatatgatgattatgacttgaggttctatccgggattgatactggaataattcttgaaggttggtggttggggacagagacctggtaatcaggcagacctgatttggaatctcagctgtaccactgattaacgtggcaattttagcaagaaacttagcttctctgaacaactacttcttgatatctaaagtgggaataataacccctactctgcagggttgctataagaattaaattcaataatgcatataaaggaattatactttctaccacatggtaattgctcaataaaatgtttttattagtggtaatcatgtatccataagcatagtaattgatatatgctgactcacctgaaaaaatggcaagtagaatttggaaatgacagcctcttttcttccttttttccttctttgcttccatccttccttcctttcctctttctttcctttcttcttttttccatctctctctcctccttttctttctctcttctttgtttctttctgaggcataatttacatacaataacatgtatttattttgatgtacaatttgatggattttggtcattgtatgcagtcaagtaaacgtccttacactgaagctataaaatagtgccatcaccctaaaacatttcctcatgtccttttgcaatcaactcctcacttccattctcaacctcaggtaaccactcatctgtttttgatcactatagtttggtcatttctagaattccatatacatggaaacgtaaattatatagttttttacattcgatttctttcacttagcatactttttgtgattgactcatgttaagtgtaataatattttgtttatttttattgctagtaatgtttcatggtatgaatatatcacagtttgtctattcactagctgatagacatttgggttgttttaatttttggctttaggaatactgttgctataaacacttgattgcaagctttcgtgtgaacttactctccttacagggcttagtgtgcccagaaaaaggacactgggttacaatgggaagtatagcacatcagagcatctaagttgtgtcttctccttgcctctagtgatgataatgagagtaataaagccgactttcatttatctagcctgtttcctcctctcagagaggctgctttcacagcccccactgtccccaaagagtcaggttagcttgtccccatctcatcactggttcattgagctgtggtagacacctgcctcaaactggaccaaatggattttctaccctgagaacgtgaaattcagaaacagggtcttttaaaattaattatgtatgcttaaactagaggtaagatagacttagctaggatgggcaatttgagtcgaataccaagacaaccgacatctccagtgtgaggaaagagacagcgagagtgagaaagagagagagagagagagaaagagagagagagtgaaactgcagataagcaatgaaatccagaaataagagactagatttcaagacagagaagtgagctatatttatttcaccctctttcagtactgtaagatgccacaaaatcctttaaactctgtggttttgccagatgctctgaaagtgttccagggaactctctctttggtttgaactaggttcagcaggcttttgtttctgacaaataaaataaccaaataatccctgactgagacaaatcataattgttatgaagatttgttgaatcctaactacctacctactttaataataattctattaatcctttcttacatcggatcaccaaaacaaccctgtaaggaaggatttttctttgaaggaactgaactaagaaatgagttcagttagtcgagaaattaaataatttgtataaggttacatgtttggagggtagcaggcctggagactaaattctgaactgcttttccccaaggtctctgatggaaatagcagtcccatgctggaccctgggtgtgacatgaaggagacagcgtagggctccatacagctcccccagcttggtgatctctctttatatatctaagaaagtgagtggagtaataggcattgagagggctcctgtctatggactccactttctctgtgaatctagattatttgctgttaataagggaagatttgatagtgttggatatttgaaggaagtcatttgtgaatgctatcagatgccaatttggaaatgcagaaagattataagccagtatggtcctataaggactatatttcatgtaagtaaagttgagagaaatagagacatttccctcttaaatgtttgcctgttggtttgtttttacattcattttgtggaggaaacacatgactttaaaaaaatgtaaactatttctgtttcttcttatgagtgaatcgtggtgggaaagacttcatggacagagtgaaaatgaaagaaatgctttctaaagcaaaacacagaaaaggagaaagctggctaggaggtgataaggaatatgaaaagactccaggagttataagagagaactcagaagttacagtgattcccctgcctggtgggcttcagaagcatttgtagaatgagtgcagcataagttttagtcatgcaatttggatgtgaatagagactttgcactatctggcctttcaccacttccttttcttttctcaacttgggccttctcatcagaaactgaggattgttacacctcacaggctagttgtatcaactaaatgggctgtccaggagtggtggctcatgcctgtaatcccagcactttgggaggccaaggtgggtggatcacgaggtaaggagtttgagcccagcctgaccaacatggcgaaaacctgtctctactaaaaatacaaaaattagctgggcatggttgtgtgtgccagtaatcccagctactcaggaggctgaggcaggagaattgcttgaacccgggaggcagaggttgcagtgagcaagactgcgccattgcactccagcctgggtgacagagcaagactctgtctcaaaaaaacaaaacaaaaaaacaaaaaacaaacaaaaatcctaaatgggttaatgcaagtaaaatactaagcctgctgatatagagcaggtgctcaataaatgtcaggtttcctatcaccacttcatactgttctttgagacattcattggtttttcaactgtttgcctttaggaggatttcttctggtctggacaatcgaagaggttcacagtgatgcacgtcatttcctggcctacagtgaagtgacaattgtacactcaaacacaaatctagatgtaaatatcacagacttatttgtagttattaatttaaattggttaaaacaccttcttagttacagataccaaagagcttaagtatgtggtttaaagcattagacgcaaaaggtattacagacgcattcagggatgatgggtatccccggatcctaaggcctagtgaatggtctcttctgtagaagacagagaggataagagtggggactaacaattcaatcttataccaaagataaataagtatgtatagatatcaacataggtatataggtatagataaataggtataaatatatatggatatagttctaaagcatactactttacactctgcatacaaaatatattagttgatagctttttatatttagccttgaatattcttttgtgcagagagactttataaaatcaatgtgactccaagaaagtattagcaggaattcaggccctgagaaagacaagcttatggagcaggtaaaaagtttcataattgggtcctccagtgttgtgctaaatacagacagaactgtcagagtaggcttttgacatttgcccatttattcttgcactaaaatgagcaatttaaaaacggttggaaagaaatcagtggctatttttgaacaccatcctctgaaagtacagcagataaaaacaaaacagaacaaatatatggaaaaatatgtagctgatatcagggaagcccaaaaaccaccttagagttacacattttccaagatctcaactgagcttctgaaccactcccagtcaaatcaaactcgattatttgtaaagatgctgtctaatgatcagtagaaagtgaagacacacaggatatgtctccatcagctcttaacacacgttggctcccaaaccttacaatagctcaaacttctcctgcaagtttgatccacaaagtgatcctgaactaacacgagcagcccaggcatgatggcatcaccccagaacagaacacttcctccaggcatacattgtctgtgagcttcaaattgcttcttgtcctgtattgtttccagatgatgagttttccataaatgttgtctcttgctagaaaatgttatattccagcatctacctttaaaggcaactatcaaaacaataatctttaaagatctgcagatgcctgtggagatgagactcataattactctgatgaaattgttgtctttgaacatagcaatgaagagttatttttatttgggaaaaagtgtagaaataagaaaatagcatagtaaggctgctcttgactttcgtacagcttcagccttttcatgaaacataactcagatgatcttcttctgaattagtgaaccctgatgttagttatataaccaggggaccacggtgtcagccttgttattttaagggtcttttccagtctgcaagacccaaccaatttccttcacctttcacatgtggacttctcattgttactaaactaaccatcccttcctgctcatctctacacatactttaggacttattgatttcatggacgttcatttgtctcacaaacttggtgatatagaaactgcattttctgctttggtgcaccccttagagagcctagtgtggttcagacaaacctgatgagatgcacaacttggaggtctcgattttctcatctgtaaaactgggcaagttgttataaggattgtgatactatacaggaaagtgctaaataccgcaggcacagatgaaaggaaatctttccctctcctggcacaatgctacggatgcaaacaaacacattgttttacctttacatatcatgagttacccagagttttctcgttcatgtatgaagggagtactaattcgtcatcaccaaagcatgagcatatttagaactggattttgagttttgtaaagatgtgtaaacttcccaggtgccagtagcaggcctgtgtagatgttgtcctcatcaaggatcagggactgcttgttgtcacgttcctgttgaggaatgcctgcacctctgaccagcctcaaacactgctgtagaggaaagattagaaatataaattatgtaaaatgcagatcattgactgaacatttgactgttcaaggagttgcattttactgcttggaataccttttaaagtgaaggagaagaaaaggaggaagggggagggaagggaggagaaaaagaagaggaggaagttgagaagagggaaagttgctccataatttacaaggctctttttttcacagtgggattattatttcccattatcacatgaaacaatcttcattacttttcttaattctgtcttcattctcacttcaccttgtccttttatatatgttctctcaacttgggaataagaaactggacctttacagctgggcacggtggctaacgcctgtaatcccagcactttgggaggccgaggcaggtggatcatgaggtcaggagttcgagaccagcctgaccaacatggtgaaaccctgtctctactaaaaatacaaaaattagccaagtgtggtggtgggcacctgtaatcccagctactcaggaggctgaggcaggagaattgcttgaaaccggaaggcagaggtggcagtgagccaagattgcaccactgcactccagcctgggcaacaagagtgaaactctacctcaaaaaaaaaaaaaaaaaaaaaagaaactagagctttacgagaccaaatatatctgaatatctgaggctttagaaaaacagaagaaaggaaggaagggaggaaaaagaaagaaagaaagaaagaaagaagaaacagacaaaataaaagctttggaattgctatagaaaggattagattagatgactagctaagaccttttctcgtgtctgtatttggggaagagaaggcatgaatttccccttttagttaggtaaacgtatttttatattgagaacctcttgcataaggacaggtgaattaatatactcattgaaaatgaaatgacttcagagctcaaaaagatcttgagaatatctggcgcagtgtttttgaaacttttaagaaatcagcataattattccccccatttatatttcagttaagtaaaattgactctaagtgcataaaatacgggaaacctggctactagggtttgaatcgaaagcagggtttgtgttatccaaggcatctttcctccccttcgctgtccttctctttctccaaggttaagtctgaggagttttctagaaaacctcaaattcagtggaacacattctacctccatcataatgtgaaaagaatctgtggtctaatctgatgaaataatttgctcgtggctagctgataaaaagcacttgtagctaacacatattgagtgatgaacctggactagatgcatgaagtacctaatctccccaccaaccctgtgatgtacacactcttatgacactaattttatagagaaggaaactgatttcagagagcttaagtgattagaagcaaatccatgactagaccttggtgtccttaaccctcagggcaatgctttggcactctacaatcttacctcctagaaacaccttcaaaaccaccctatgattagaactgaattttagcatctacaaaaattcacagttcacttttagttctctgttttcctgggttcttcccaggaatttaagttattttgagaccagagaagcttaaggcattgacattccacatgccctcaggatttaacttaagctccaggctgtttcaataccaaagattttgcctcaaactttgccaccactgagaacttggggatgtgaaaaccactgaggcagcaatggcaaagagaagagtgggaaaggcctttccaggatccatgtgcagaattagatttgtgtaccacctgtgataactgggaaagatcttttttttctggtttttttttttgttcctttttttttccacgttggaggcaggaataaagcaggtgagggttccatcagagtatctgccctaatttcctgtaacagcaacaggagttacccattactcctattgccaatagatatcatggcttcactcctaaaccatactcagagcattcacttgttgatgttagtaaggaaaagcaagttgtgcataagcagtattatacagcatgcttcagtacagtttgtagctatttgcttaactgaaatctaggtacaagcctcttcaaataacagatcttctttttctgtatgttccttaaagagaaagaggaaagagaaaagaaacatgcctggagtgagcatttatcaccaagacaatttccaatttcatctcacgatcaggtttacttcccaatattctacaaccgtaccattttatcatgggcataaacattgagaataatgactcttgtgtcttttcagagcctaatttgtgatgagagaattttaatgttggaaacaaactttaaaggtaccgaagtccagacgtctaatataccctagaatctctctgcagctcgttggcaacagacatctggcccagctgtgatgctctaataagtccaggcaagaggaccatagcactttagaaagacatgaagcttactgaagatatgacttacaaatagagcttttggtacagtgcagtctgaaactgattttcctaaaaataaaatgctcacgtaggtctcaaataaaggtgcctcgctcctcagatagatagaaaatagtacaacacccaacctaaatagtcaaaataaaaatattgtgtatccaaaaaaaagttttagaaatgtatttagttaccacttggagccagaggtagttgccaacccaatttcattataagtgaaatttctagggtattaaaaatggctctcctcttcttcttcctctcccttttccttcttctttttctgttgattttttatcatttaattttgatccacaattctgtataacatctacatctcatatcaacctttttttttttctagaattattctactccctgggtcagtccccaagatgtttcacttcattatggatctccttagcgctggtgctaaggttaaaacattaattctccgcatgctgagagttacttagctccatggtgaagtctctatctgccaaaagtctctgttcaaataaatatgtaactggtgattctacagcatgcattagaatcatgcagagggtttgttaaaacacagcctgctgggccccaccctcctaagtctctgattcagtggatctgagggagcccaagaatttgcatttttagcatcttcccaggtgctgcagatgttactggctcagcaacaacacttagaacaactgttctagaaagagagtccctagaactgttgcattctagttaaagatggtgggaatgggaggaagacattgctctataccaggctgttatgggcaaattcgggagataattgtgatgaggttgaaaggtttgaatttaatctccaaatttcagtcagagagtaagattcattaaggcttttttccatccccctgcaaagtccattcttccagccagctcttgctccagccctgctgtgatgagactctgctgttttctgttttagctacttctgcagctctcccaaccctggaaaagatgaagaaagatgatgattttgttctcagctcttagtctttagcctttggacagccatcaaaagtacattttaaggaaaagggggaaaatatgtctactaggagaaatgccttgtattagactattatatcagtgatttgcttttacttaatgtagtattgaggagaaaatgcctctcttttattattcaaatggtttgcttttactttaccaaattacaagaaagcataccaaatgcaggcttctaaatagtttaaactggtttaccacattaaactcaaaagagagtatttcattaaaaaatataaatggactggagctgttttctgacaatacactgttgggctttttttaaacttctacttttgttttatgaaccgaactactggtgtttaatactcaaagatgctcagcttttaggtaatatttgttgtaggaattcttaaaagccacagatactgctaatggggaaaaaacaacttttcttatgttgaggttatagcaactttggtggataacagttaatacaattagttttccatcagtttctctaaatgcattttttttttctaactaactttagggtattctgtatccttggcattgatttagtgagatcttcattacatggcatttcactttagtttccattgcagattgatatcacaggtaataactgaatctttagggtttgaagaagctgacctttctttaagagatctaatcatttcacggacaagttccagtggtatttctattaagaaatcagggtatggctgggcacagtggctcatgcctgtaatcccaacactttgggaggccgaggcgggaggatcacctgatgtcaggagttcgagaccagcctggccaacatggtgaaaccccatctctgctaaaaatataaaattagccaggtgtagtgtcacatgcctgtagtcccagctactcgggaggctgagacaggagaattgcttgaacctgggagacggaggctgcagtgagctgagatcacgccactgcactccagcctgggtgatatacagtgagactccgtctcaaaaaaaaaaaaaaaaattgtctgtcttcatggtaagataatcaggactttaaggaagtgtgtaagacattttactcatatttttattaccagtttacattatggtttctaaggccattatgtgaatccaaataccatcttgaaatgaaaacacattaagctatttttaatctgcaaattatttgatcagctgcctcagatacatgaagaatctgatggcaagggcacagaatagctaaagtttaacgggaaagctggtactatccaagtcagtgaggtgaacacccagctgcagagcggaggctcagaaatggtgagtgccaagatgaatcaagccacaaaaggaatgtggaggacctctgaggtttagcttcatatattgggcaatgtttctataggcagtcattggcctttcgtcttcgtcttctgcaccgattcagtcatttcatttgtagagtcttcctcaacatattgtttaaaaaaattcaagatttttcaaatttggttttaggatttcaaaaacaatcaggactagtatgagctattcattttttttttttttttttttttttttttagatagagtcctgctctatcacccaggctggaatgcagtggccaatttcagtttactgcaacctctgcctcccaggttcaggtgattctcctgcctcaacatcctgaatagttgggattataggtacccaccaccacgcctggctaatttttgtgtttttagtagagatggtgttttgccatgttggccaggctggtctcaaactcccggcctcaggtagtccacctgcctcggcctcccaacgtgctaggattacaggcatgagccaccgtgcagggcctattcattgtttttttgttaattctctaaggattaacttttgggccatgttggactgacagattctgtcctttgctctgcttatgttttcccttctattttcaggtagtgattaagactgtgaagacagaaggtctgaattagcaatttttcaggcagctgacttaataatttagactaaaattcgttccaggatgcttgctcacctcctgcatgtggtgtcctagaaagcctcttgtttctccagctgtcctccccggcagcattggcatcacctgggagattgctagagatgcagatcccaggccctcgcagatccatggagtcatcacctgcattttagcaagagttccaggtgattcgtgtgcacattacagtttgaaaaatattggtaaatattatggtcatcatagcgggttatccaactactggttttagctctgccactatctaattgtgtgaccctttgccagtcagctcagcttttcaaactgtgtttcatggagctgtatccattcagtttattactcagaggctgggtagtaaggtcagcagctcccatctgagccctgagcgactccagttttattagtttttatctgttaggctttaacttaagacactgtttgaagaaaaggtttgcctgtgaaagagatcgaaggcctactgtctctgatgagtcttaaagtcatttcctgatctgaattttctatgattataatatcattcattgataggaattgtttccttagcgaaaaggaaaaatctcttcatttctatacatgtggcaggttgacatttgtcaggtactgaggctgacagacagtttagctacctttaggaggttccttgatcaaaatagagaaactttgccagccactgaacttctcactgttttcctcatcttagcgacttaatccaggcctcaccccatctgtcactacagaagaactgtttacgagacctcactttactagcttttatttattttatcagtgttggttatttgggagcaaactgaccctgagctatcctttggccagtgccattcactttgcatacattgatctaaaaaggcaattgggttccgaggtctgagatacccaatgatattctacatgtgacaaagacatttccagtcctgcacaccctggtaacctaaagaaggccaagcatctcaattaattttcagttgacagtttctgcagctgagtccccaagtcagagtccctaaacaaaattgtttgcattctataggaaaataggacacattattagcccagttctaaatccagttccatctttcctcaaacaacagcaaatgttcttctcagattcatagcatggagcatcatccacttttaatgttttccatccacatagctgcattgccctgttacttatttacaaatttattggctttagatggcatattttctccaaagaactcaggcagttgaatgagttgttttagaagtctacaaaatatacccttactcattcacctgtgggatttacatgaggttatttcacattcctcttcatgtattgcgatggggttgttataaagatactcacacctttaaatcttcccagtagcacgtatatttctgctttcaaacacaacaaccaagaaaaaagaaaattctactgaaacaactgaccaatcttctttccttagaaaaatcaatctcatcagtagctcatgaaattcaatttccctggtcaggaacaaagcagataatcatcccctaataatatttatggatgacagaaatgcagagcaaataaaattagcctctaaaactatcatcaagttccttgaaacttttttctttatctcaaggggatttatggagtaatggtaagtgtgtttttctccatttctatttaggccaacacacatcagaggcactcaatagatatctggtgaatgaatgaggagtgagtaaatgaataaagtaaaatacagatgaccctcaatttggacataatgcattcctagagactgcttcataaaggatattgcttaaaggcaaaacaccgactgcaagaatgccaccacttttgtctgtaaaattcattacaaattgacagcagataaagtagcatatatatctcttcattaggtaacagcaaataaatggaaaggcaaaagagggccacaatgaagcatgaacaatgtatagaattctagtaaaagatgattgcataaggacatttttaccttgcttctctttatgaaagtgtccatcaatatgaagaaaaagaagggaagaaccaccatcttctccatgacagcatgcctaaagctagtctaatcttctctctgtcttgaaaggttttatggatcctgtgagtctgcttatcacagtcatttgaagagagaaacaacaactgccaatcatgaaacagaggatgtgtgagatatgggcttgctgtgaaccaagatgatccaaaggggatgctgaaagcttagcagaaccaaatactcaaatagaaaaaatgtggctgatttgcttcaacagctttccgagataatataccaaagtggaaactgatagcttctccagatcatacttgctcattctgtccccgattcttgggcagaactctggtctagagagaactttccttattccaagaagcaccgtgagcagaagacctaaaacaagacccatagagtaaagggacatgggaaacaaaatggcaaatctgacatcagaaaaaaatgaagaagaaaataaataaaaaatatagccttcatacttttaagtaaaatgagtgtaagctagttgcaaaagacataaaattaataaaagataacaacttaataaaagatatcaaatctaatctgtctctctcacatgcacagacacacacacacacacacacacacacacacacacacaaagtgttgaaaggataatcaggcaggccgattttaagaaataaatgtaaaaataaagtcatcaaaaactgtcaccgcattaagaacctaaaggattaagaaagacaacatagaaaatagcatccatgagcatagaaggcttgaaataatcacagaaaaagaaatgaaacaaaaaaattagaaagcgattagatacaatattatagatatggaagtcagacatagaagatacaaattatgatataaattatagtctaaaaagagaaaaatataacacaggaaaatttaaaatatttgttaaaataacatctcctgaaatcaactaaaaccagaatcttaatgttaaaaaaaggtctattgtgttttaggaaaattttatgtgaaacatctcctgatgaatagaaagtctgtggccatccaagcagaaaaatcaagctagtctaaaattcttcatggcagaattgaatgccagaacacagaggaaaaattgtataattatagatactattatccaaggtttttttttttttttttttttgagatggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtattttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacacccggctaatttttttttttgtatttttagtagagacggggtttcaccgttttagccgggatggtctcgatctcctgacctcatgatccgcccgcctcggcctcccaaagtgctgggattacaggcgtgagccaccgcgcccggcctatccaaggtttttatacccagtcaagctgttcttcaatgtaaaggctatatactaataagcaatctaggctataacacccatgatccttcaaaaaacaaacaaacaaaaaaaccagctgatgaaagaacctaaccatagaagataaatcaaagaactctgggttagagaactcattgaattggtattgaatctatatatacttagagataggactaaaaaaacactctgggaattatgataatagaaatataaatattacaaatgtattactgcatctttatattttatttttcaataattatataatcagcaactgggggaagcagttaagactttaagtttggggagaaatgatgcctctgattggtctttttggggtgtattaatccattcttaagctgctgataaagacataacagactgggcaatttacaaaataaagagaggtttaatagacttacagttccacgtggctggggaggcctcacaatcacggcagaaggcaaggaggagcaagtcacgtcttacatggatggcagcaggcaaagagagagaacttgtgcagggaaactcctctttgtaaaactgtcagatctcctgagacccattcactctcatgagaacagcatggaaaaaacttgccaccatgattcaattacctcccgctgagttcctcctacaacacatgggatttcaagatgagatttgagtaggcacatgcagccaaaccatattgggggtgtcttaggttaggttctctcgaaacagatcctgagacaggaatttgggtaccatggttattgagtgagtgctccttagaggaaggatgtggataaacaggatggggagacgttaaatgaagatgtggtctcagcttgagtccagcttcagtctgatcccatagagagttctggagcataaattgaaccacagtgctagccccattttgaggtgaggggctggacttttgttccctcctttcaatcagtcattgactgcaggctgttcaatagggaagggataaataggggtgtaactttagagctagatggctcgacttccatgctgggtaattccctgaaaaagagacagctgggggctttagcaccagcacccacagcagcaggggtctgggtgcatcagtctgtgaaagcgaatcttggcagtttcccaatggtgtctcctgtagagcattgatagctctggttgatgttagctttccctgtcactgactggtcctttgttatcctttattatggcttataaatgtcagttttcagtgtctgaatgcatttcactgagagaaggaaagaaaagaggcgctgtagagggaaaaggaagtggggaaaagcctagactttttttaaggagaggaaatgtgccagtgagctttgtggaagttgtttcagcatggagcagttatacatgttgccagatgtggagtctcaacaatctcagagggtcagcctctttagctatgaagtgttgctttatgccctccagaaattatccctctctcccctccacctgctgctcatcccatcccccttttctctctactcaccctaatgatccatctcacaagagatggcatgtctcaaatggcaagaacaggaagtgacaaacatagacagtgttggtaatatcgaaatgaaaagaaataattgtctctgattaagatgagactagaaagacattgacattgctctttgtagcatgtactagggagcacccaaatctctaagagaggactaaagtgtggcattttgcaaacttactttacaattgtacccattgtctgttgactattcagtgggaataacattctacaaaaacattctttagcaaatgtggatgtaggcaatgagatccagggggttttcaagaaatacaggtgaagatgacatttgtgctttagcaataactcttaaagaaatgtggaggatgggttagagaggaaacagaatgtcagggaggccagtgagggctatttcagtagtctaagtaaaaatattaaagtcctgaactaatcttagtagttattaaagcaacctcccagataacgcaggatcccatatccctgacagaagagccactgatgcttctgtgtccatgaaacagctaataaaaactgatgtttgagcctaagcattaagaatgttttcctgatagggagctaaaataatctttgaaaatcacacccaaaatattagtcctgccctttgaagctatgcagaacaggttgcttgttcactaagaaaaagatgtatatatcaagtgctgtcttacaagtgggaatacaaaggtgaggaaggcatagccgtagctctcaaggagctgaatatctagtgagaagaaaaagacatactcaagttttgttgcaataaatttcagcagaggaaagctatagggattttagaggaagaggtgaatgactgtccaggcatgctaagaggattcatggtgcctttatgaaataatccttctgatataggagggaaggaatcaagtccatcctacccctacctcctgtttgtttgtttctcagtttgcccagttcttgaacttgttcttttattacatgaatctaaatttcattgaatcccattccttcttcctctggagattttgtacttttccaatgtttttctttaaatgtaggcttccaatcattggtcattgtctcagctgtgatctgaggaacgtagaattcagcatagtgtgctgggaagtggcaatgtacccaaaatgtgtgtggaaggcttgccagtatattagcaataccttccctctaccctttgagttctccttagaggtttaactcactttctaagcctccagaaactgtatcctatgttcctttatattgtattagaaataaagaattggttaaactcaaaataaatagatgttagtgcattaacacaagcctgtacccattataaaaatgtatttggcaaagaaggtaatgtttaacccaaagaaatatcctttagggaagggattttaggcaccttaatgtaaaatacacatttggtaaagaggccctcttcagtacacttgagtcacaccatatattcaatttctgacttcataagaggctaggtcctgataaaaatattgaaggaacacatgtgttaaaagtgtagtataacatctactattattggatgctacataaaaagcatggagctaagcaattctccatgtattatgatcatgcaatttcaacaaccactctataagatatatgctattatctccattttacagatgaggaaactgaggcttagaagtattgttcgagatcgagtgaaagaggcctagttttcagatcaagaaatttgattccagttttgattttatcacttactgtgattttcgcacaagtcatgttactatgtttaaccttttgtttctcacctgtaaaatgaaggaagatgactaaaccatttcttggggctgttccagttgtatgattttatgaacatctccatgaaagtatctttatttagcaaatagccaaatctgagaaaaaggcaaatttattagtctttctagaactctttagcatcctacctttaccatgaagcattactccacattggctggcctgtattctttccaactcctaaacagtagctcttctttcaaatgtctccctctatttaggcacaagcaaggtgctgaaaagcatgagaaatatgagcataatacaaggaaatcgataaggttaggaatcttcacacgtttaacttaatcatatcagacactgaaaacaaagtcatattttattgccaaagagaaatgctctttggcaaaccatgatagtaatctgattgtgaacaatgcttattcatcatttctggggcactggctgctgtgccagccaaggggacagctgacctaatgggcttgaagttgcattcctcaacattagttatgttgttgtgtgcaatcaccaacacaaagatagtgtacattggtcaatcagaaaatatgggctccttgcttgtttcccgttctgtttttattgacgattgggggataaattgcacagtgatagccaagagcataaattttctttgtacttttatataatcttgtttctcattttacaatatctgtatttattcctaaagttgagaagaggatcagacattacaaaacaatctggaaaaggtatggtaataatctaaaatatcccatagaaaacacctttatgtgttgccctaggtcactgaggcagttataacaaaaaatactatagactggatggtttaaagaaaaaaacagttatttcttgcagttctggagactgggaagtccaagctcaagatatggcagatttagtgcctggtgagaacctgcttcctggttcatagaagtctgtcttcttactgtgtcctcgcatgatggaaggaatgagagagccctcttgggtctcttttataagagcactaatcccatttatgaagtctctaccctcattacctaatcacctccccaaagcccccatctcctggtaccatcactttggtaagggtttcaacatataaattagggtgggggatacaaatatttagttaattacatgtgtatttatgtctcagagatgaggaggtcttagtttcaaatagttacacctatgcaattatcattccaaacttaacttttcctgtaatcctctccttttgatgtcataccatttgtacactgtgtaaacagttactctgggacatagtccataatttacactcccttttccttaattttactttgaggttccttctcagggcttcctttggactctgtggttacctctatcataactcttatcacatagaatgagatataattatggttgtgagatcaatctttagacgagagtttattgattgtttgtgactagctttgtgttaaatgtggggtcactaaatcctgcatacacttcttttcaaccaggtattgtttcaataattccctctatctctctataaaaaattgaattccttaaacccgggagtccttatggatcagagcaagtgagcagcacatcgcattctaccaatttagcttttttacagaatcccagtccaaatgggactattccgtaatgttctgtggtcgtaactgttgtccagtgtgattggcctggttttcttaggcatgaaacatgatgtattaattatgatctgaacagtgagccagaagttactgtatctagtttgacagtattaacatttatggcacatagttaaacaaggacttttgattctgaggtaggaggagttgggaagatatgagcagaatttttatacacgggggattctgattagaggatcaacaattacaaagtatagttatgcaccgtttaatgacagagatatgttctgagaaatgtgttgttaggcgattttgtcattatgcaaacatcacagagtatacatacacaaacctagatggtatagcccactacacacctaggttatatggtacagcctattgctcctaagatacaaacctgtacagcatgttactgtactgaatactgtaggcaattgtagcacaatgataagcacgtatataaacatatctgaacatagaaaagaaatagtcaaaacattgtgttataatcttatgggactaccgtcatatatatggtttgattttgtccaaaacgtctttctgagacacatgactgttgtctcacacaataaagagatagaaccttcataaatggagagtggagtgtcaatgcaaagtgggattaaatcaggaacttacttgaagacggaaagaggaggaacaccttcagcaccatctctcccatccttatcccaaaacactgatgactttacagccacctcccatacacactgcaagcacagggcactgcaagaagctgtggttacagaggagacactgcctaagggatcagtctgagtgccactggtatcttatggaaatacaagccagggactatcatagtcaatggaagaggattcgtgttaatgtcccacagtcagccagaagtgcttgtgactctatgcataggcacagtgcctttgaaaattgactttcaatcactttgtgagagtgaacactgttactgcagggtctagctgctccacccattgttctagatgggagataaaacagcctaactctagctggatgctcagtccaaactctaggatgagggtcaaggcagggactgcactattcattcatgtttgcttttctgggactcctataactgatgccttggatttgtgggatggttggttatgaccagtggctacacctgaggaactcactgtagcttgatggttcatatagatttgagattaccaaaatgttattcaacattcatactagatggtcttgaatatacttcaaattcagcatgttctcatctgaactcacatctcaacatcaccacactgtccctttcctttttcttatattttcagagtatcagtataaatctcattgcaccaggcagaatctgaggagaaatccttgcagctccttcttcctgattcatcatcaaagcctactgattttgcctccaaaccattcacttctgttcctctttacatatggacaatgggaggaactgactaaccacttgggcttgtcattctgtttgacccctttccccagatgtattctttgtcctctgccctattctgccttgaccttgacttatgccctccaagtgggtctggctgagaaataactggcaagagatgagcattgggaaggggagataggaaaatatttatctccatctcttgctttgtcagctcttctggttgctactgcccctacctgccaggctttggtaaactgcccctctccttgtcccttcaagctatgatgtggtgcgccaatggctgagtcttcctttttgactcctgaattttgctcatatctgtgttagtgactcctttgctacattttctttaggccaaccactttttttcttgaagaacgctggacaacccactatttttcccatactcatgttgcccacttcaaaactgctcttcatcctctagagagtggtcttttaaagggtaaatttgaccatcacttttctgattaaaactctccaaggggatcttgttgatcttaatattgacagaaatagctctaatgtggcccacagcctgtatgagctgactcctgtctgcttctccattgtcatctcttgtcacagtcactgggttccagccatgttgctcttttattgttccttgaaattgccatgggacctccagttttgaaggtcttctttaattcttctgttttcagaaattctctgctcctttcttgcctcctcccatccctagcctgcaattttataggaagtgttacattcctttttaaaaatttttattttaaattcagtggtagatgtgcaggatgtgcaggtttgttccataggtaaatgtgtgtcaggggggtttgttgtacagattatttcatcacacaggtattaagcctagtgtccattagttgtttttcctgatcctctccctcctccctccctctgtcctctgataggccctgttgtgtgttgttctcctctatgtgtccatgtgttctcatcatttagctcccacttacaagtgagaacatgtggtatttggttttctgttcctttaatttgctaaggatgatggcctccagctccatctatgtccctgcaaagaacatgatctcattcctttttttatggctgcacagtaggaaatgttacattcttagagaaaatcttcctcttcatgacactttatgacatttctgccacaggagtttgattctatagttaatatgttctcataacaccttatatctttgctccaaagcatttatgatggagtataattacatagaattgtttcattgatataaaataagttccagtgtgtgtggaaggatgttctgtgccttgtttttcattttatctgtaacaatttgcacaacttgtggcaaatgattatcattttataatagttattgggtaaataattaaaaagtatctctagctaaggccaaccaggacagcaaaaataaaactaaaatgaagagcacttgaatgagacagcaacagcagtgaaagtagccttccatgattattatcgaaatatctgttgggagttaagctgaaaactgacttgaggagtttgggaataaacatagcccacagtcagaggaaggggctcattcaaaaacatttagttgctctcaggtcaacgataggtctcaaattccatttttcacgagcatccacaataaaacctcagagcacaagccaataactcaagtactcaaatgccctccagggttccttccaagttgctctgctgacctgagctcattacttttatataatgattgcagcagaagcatctatggaagtactgtctacaatgagatagtcaaaaaaatactaaggagataattacagtattaattcttaagttttgcagaattaattaaacataaaaaatattattttggaacatcaagtttggatatatggtgacaaaacaaaaccactgctggccagtgagaacttctagggaatctatattatacatttttacattatgtgaatttgcataagtaaattatccagaataatttactcatgtcaattaacagaaaaaaaaacatgacttaattaaaatctcattacaggaactctcttcaatcaataattttggaaagtgacagacaaagatggtccacagggggatacatgaggacaaacatagctttagataagactgtgtttgcaccctagactggaatgtctcttcctcaaacatgtattaagccattccatttactgagcacctcttatattctaagaactgtacttgtcatcgtggtgggggaagggaggcataaataagctgtgatacttgggacaggacaaccaaaacctagtttccttcaaataggacttgagtcactcatagaagtctttcctaaatattccggtcttcaagaatttctctgaagacttctaaaaagtactgcttatgtcacgtgtgaatcctttcttgatgatgatgatgatagagaagtatttattatgaaagaaagaaagagaaggagagagagaaagaattgacatgagccaattcccaaaataaatcttttatatatatatgtatatatctctccctatatatatctatgtataccatatatatatatttatatgttacagataaaatgaatacatatatatgtattcatatatatatttatatgttacagataaaatgaatacatatatatatatacctatacacacatatctcctattggttctgtttctcttgagaaccccgattgatacatagatagaagagtgtatgtaaaacggaagcaaatagatcttcatggaagatcagttgggtatgaaagcaaagagctatgaaaagtatatgatgcttatttgcttattgttacttgtacagattttgatatgtattattgtaatgattacttttatgtcaacatgactgaactaagggatgctcatatatcttgtgaaacactatttctgggtgtctgtgaggatgtttctggaagagactagcatatgaatgggtagacagcatcaagaagattgccctccccattgtgggtaggcgtcatctaatccactgaggggcgaaatagaacaaagaggctgaggaagggagaatttgctttccgtttgaaacatccatcttctcctgcctgtagacgtgggtgctcccagttctcaggtttttagactcggatcaaaatatatgccatcatttctctcaattctcaggccttcagactcagactgagttacaccaccagctttcctagttctccagcttgcagagagcagactgtgggactccttggcctcccataactgcacgagccaattcccataataaatctccatatatatatatatatatatatatatatatatatatatatacacacacacacacacacacagatacacaccatatatatctctctatatatatgtataccatatatatatgtatatatacacacatattctcttgagaacccagactgatatatagatagcagagtgtatgaaacgtatgcacagtctataaattatatagtaatcacctatctacccacttacctacccactacccaggtaaagaattagaatatggccagtgtcttagaaactttctgtatgtctgtcctcgattacattctgttttatcccaccctccagaagtactcaccatcctgtttttaggttaattacttcattgcttatacttatgatattatcaacagtgtaaatgttttcaaataatatgtggattagttttgaaatttgaatagctgtgtaagaaaagagcaatattgccactattacacaatgcctcccaagagaagagaaatagaagtctgagaaatctcatggtcccaacttcatggaaagtttacatggatgagtctcctctaggcatgtcagaggccccactcagaccacgtggtggggttaaggtgtgtaccatgtactggatatccagcagggatatgatcaggggtattctctgcttctggactcatcgttccctacctacagctctcagagtgggtcaaagctgaacatttctgtgaagcaaattgagtgtcttcagctgattcaggaagcatggcagagtggacaggatatttattagcacattgacaagacaaagtcagaccagctactattgagaatcatgcttaccaaggaattttattctctggtaaaaagttggtatgaggtgtatgtatcatggcattgggcatcttagcgtgtataactttcagtgcatctgactcttggggtgcattggtccaaactctgggttgcccttgaatggggggaactctgtccttctgatataacattttatggtgctccatagattctcacatcctttctcctatgttgaatgacctgcttcctatgtcttgttctttgttggcttattattaagtattattattattactattatcgtagagctcatatttgagtcacttcttaagaaaggaaaaggagtgaacaatgagaacacatggacacagggaggggaacaacacacactggggcctgttgggtggtggggtaggcagagagagagcattaggaaaaatagctagtgcctggtgggcttaatacctaggtgatgggttaataggtgcagcaaaccactatggcacacgtttacctgtgcaacaaacctgcacatcctgcccatgtactcctgaactaaaaataaaaattaaaaaaaaagaaatgataagagggaagtgaatttttgaatcttgaatgtttgaaaatatctttattgaaatatcatattaattgctagtttgcccgggtttagacttttagatcagaaataattttccttcaaaatttcaaaggcatttttcaatgtttcctttcagggttattgttgagaaacctgatgccatcccaatcctcaattccttatcccctcatttgaagcttatagaattgtgatttcactgtgctggaagctcactaggtcctttacatctaaaaactcttgtcattcacttctaggaacttcttttgaaatattacagtggtaattttctcctttctcactgctgtgatatctctttctagaacatctgttatttggatatgggatgttctacatactttgttctactttacagtatattctcttaactttatcttacaactcttcaattgatattttcattttatttcctgcttattatttgaatttctaagaactcattcaaaatgatgggaatatttttcttatgtgttattctctttttgtttcatgtctgcattaccctatccctctgagactatgaatcatagctttatgttcctttttttggtcttcttttggcatggtctctattttctcctagttcctctttgttctgtttgtcctttgggtctctgtattctattttagagtggcttctttatcttagaggctttcctttaactctgatatccagtaaacctaggtacctgttcatgattaagaatgaactactcagaggtttatttgaagctctcattgtctggtatgttgtcaactttcagattcgcaagaggagaatgctccagtgtctttggtaatttttccttgtgctgctcagatttcccagaaaaccctcccactcttcctcctgtaacagcagaaatctgactgccagagcaactgtcttggagattaaacagtcagcattatttttacatagttacttatttcctttgttttcagtatggtgcccacaccctcaactgtgcttgatgtccctagaaaccttctgttttgctttttactttttttttttaagggaatacgtatcaacaattttatggtgcagcaaacatcttttagagtcatggagttgaagagaatggcaactagtggtctacctgattcttagatggcttcacccaaatatctgttactttgacctcttccttccctttatctgcctctcctggttccaaacatgactgggatgcccccttctggggccccttgaggatttgaggattctgtggtgtaacttgtgttggttttcaattttctttgatactgacttgtaatttaactttctcggctctatcaagttacttcttatccacttgcttttggcttctaaaatttggctgctgttgtcttcttttctttcttcccatttgcaagagtttgtttctacaaaaaaaaacattgtttataatgaatttagtgggtttcatggggaaacaaaattaatgtatgtgtttaacctgtcatcttaaccagtaactcggctggtgtagttttaatgttaagctttcacctatttaacacatatttcttgatctctgtggagtgaagaagaacatcatctcgcctccataaattctaagacaattacttttggcatcatttagataccctttccttattaagtttaggatagtcaagctttcaagcactaaaagtgctgggtaataatggtaattagccaaattgggaaaataaggccatctctctacctcgtaatttccttttttccctctaggtttagcagtacaatttgaattaagacaaattcagatgttctctaaacatattaatcccattgcacccccaaattatacactttttcttcttctaatgttaaaatagttactaaaccagcgaatgttccttaaccacacttatgctacgagccccttatccaaacattctctcagtttggatgatttcacctcctgaatatctcctgcattttttccttttgtattttccctgctgcaaatctctcaaacctacctctttgattgctgtcagacagtttttttttctgaattacaaatatgaccatgtcactttcttttttaactcccaaatgaatctgtattgctttaataaagtctaaacttagagcagcatcaaaagctgtcaaagatgccctaactgccctcgtattttcaacctcatttttcaccatggctttcctgggtgcagcacttcagtaagaacacatgcaggtgtgtgtatccatggcagactccaggcaatttcatactgctgtgcccttacacatgctgctctctctgcttggagcatcctccttgtgctgtctcctctggtgacatccttcaaaaccaggttggatgcctctaggaatctctcaccagccctcttgaggttgggctcagagccccttctttacccatggagagtcctctgcattggtgcatcctgcatcgacatggtttgcctgagcttccatgccctcttggagccccatgattttattcctcatgtcttgcatgctgcctgacagtgtagaatgtttcctactgtgagaatattgaatctgagggctgccaacagatgaatcttttcccttagaggaatgttttacccatttccataattatttcagccatttagatttaaaattcactcactggcctaggattaaggtaactttagtgtattccttttttttctttccttctttctttctttttctttttctttttttttttttttgagacgtagtctcgctctgtcaccccggctggagtgcagtggtgccatctcagctcactgcaacctctgtctcccgggttcacaccattctcctgcctcagcctcctgagtagctgggactacaggcgcccgctaccatgcccagctaattttttgtatttttagtagagacaggttttcaccgtgttagccaggatggtctcgatctcctgaccttgtgatccacctgtctcggcctcttaaagggctgggattacaggtgtgagccaccatgcttggccaactttggtctgttcttcatgagctgtttaatttctctgggcctcagctatgtcattttaatcattatttgtttagattcatataatttaactctagcattgtcatctttctcaaaatccttctgtcttttcctgatacttgtccctccagccccatacatccttttctggtgtttcctacataaagtttgctgctagcaagctctcaataagttcacccaagttttagctaataatttcaaatacactcccaaatggatttgcattactagaaagagttctggatgcttgaaaagtcttataactccaaagattaaagcttcctatggatgggagatttcatagtgctcattaaggatattgggtgaaggggctctactctggatcttctcctcccaccacctaaataactgtaccacatgcctttaggagggtgtgtgtgtgtgttacagaacatggtctccaattcttttgcttttatttccagccaatgagctcagggatgtgagttggatagaaacagtcggctagactaccgtgagatctgaaggataggtgtttattttagtacgtttattcagagaatagcaggcacctaggaaggaaaaccgattacagagataaaaagcagttaggatctctcggaaggataggaattcatgtgcattcagaaagaaaaaaaaacagttgttcttgtgtgtgtaaggaaaatcatctctgtggaaataggttgtttacgttttcaagtcggcaaattcccttcacagccacaccacgtatcaaatagagaagggagacttttttttttggtccctggtgtgcacaaggaggatcccttgagatgcatcctcgtggagcaggaaagatcataatagcaataatgacaacaatgcatcaattgttctcaaaggcatctatggggcagagtatgcttttcaaaggacattcacttctattccatcccatttgatcattatgacaaccgcaggagggagataagatgggtttcattatcaccatttcacaagtaagcatcctgagatggggacaatgtagagttatttttctggaatcacagagctagctagtggcagctttggagccagagcccagttttttctaagaatttctgtcacataaatggattatgtgtactgcatgaacacagaaatgcccaggatgtggagaaagcccaaacctctctcttacttggaagtctggatcagtggttctgggaattcgcagatttgcctggcagttctcttaagaggacacagaaaggccaactgggaaatcccttaacactagttcattgataccttgactatcttagccaggagaattggtgtttttattttccctggctagctgttgggtttgtaaatctccagagataaattaaggatttgttcagtggccttgaatgaatcatgaattgtttcataattgtttctttatgcaaagaagagcagaagggagtattagtggcctggttctttggacggtgtgtctactgacctggtatccaagggatgtgtttgctctgcttgatgaacagagaagaaagaagaggaaaggaaagcaatgctcagctcttccatgtaacacagactactctgcatttgttatcccatcagctcagaatgttaggtggcaagggttttggagatctagtgcaaacccctcactcagagaagggaattgagactcacagagctgaagtgtccacctaaagtccagggaaccagttaacaacaaagctgagactggaataaaaaagccaataggactagtttctagctaccattttcttagaatctcctttgtgcttgctacagtgatgcacacttgtgtatctgttgctctattgtttcttacattccccaaaattgagtcctattattccagtgttttagtgagggtaagttaggctagtttgaggtaacaaagtagcactgcaatctcagaatcattaatataacatagatttatttattgttcttgctactaatttagcgtagattagtgggtgacagatgcagcatgtatggaagtgcttcttcttgtcactgccaccaaaggacccagactgagagaatgtccaacttgcagtaggtgcacccgagagcacacatctctgggtttgctggggcaaaagaagagaattcccttctctgtcgttaggcccataagagcttcacatcgctttttctcatagccccttgatcagattagtcacacatacccatccaactgccaaagagctgagaagtcactgtcttcctgtccttcaaaggagatgaggacagacactgaggaacctgagagatgacagccactttgatcttcttgcttctactcataacctttaattgccacatagcagacaaagtgatgtttttaaaataaaaattgtattttatatatataaatatatttataattatgttatattacatgttttatttataactgtatattacatataaattatatttataattatacacataactattgatacaatatattaaaaatatattataaacacataattacatatatacaattatatataacttctaggaaaagtaaattcatatatatacatacacacacatatatatatacataaattcattattatttcacagctctgatggaagttccttccgactgtatttccttcctatcatcttaagataaaagacaagccactgtgccataaggcctctaggcctgtgtggcctggccttttctattctcatgcttcagtcccctaaacgtgtgctgtagcaggcatgctttcttccagttcttgcatattccaagtgctttctttgctcaggttcttgacccctgctttctttttgcttggctaattcttatgcagctttcacgtttcagcttcagtgtcatctctgacctgctctacgttccatgcacgtagagagcatgggtattttgttctccattatagattcagcacatcatactgcacctggcacaaagaatatactcaataaatatttgtttatattaattaacaaattaataaatatttgttaaatgattacacgcaagaatgaatgatcagaggcctcccatatacagcactatatgtagtcttctaaagcacattgacatagccataacagataaatcagtcacttagaacagcaaccatttatattcttttatattcttagcaatattattatgataaagatgcccacattgcaggtaatgataattccaagtgttcgcaattcatcacctgcctactggacattttcagcatacaacatattattatttttagtattaaagtacataataggaatggaaatctaaggtttgagtaacaggaaatgtgcaacatattttcaaagacagataccaccaattcagcctctctcatgagaccaatggagtgatattttccaaataaggtatcaaatgcaaagtgacaaaggatttttgcatcatttccaaatgtggaccagtacttaagaagagtagttttaactccctacattgacatagctaaggcaatttgatggttcggaaggacaatggcatggaatatgtataattagaactgtcatggagaatctgagacagattgttgtcatctagtcagatctcaacagaagaaaagtgattggaagcctgatatacctattttaaaaggtacaatgagtggtataattaaaaaggttgggtataagcttgacgaagttagcagatactcattaaaaccatttcagtaattcctataataatactggccatggttttaaagtcacctagtgaaagtcattatattgaaataattaaagaaaaacttcatattgtgtttccttggcaatagaacattcagatggagccacactaaatatttttctatttattgcagccatctccttaatgacacttttcagcacatattatacattaaaattgtttatgatattttgttattgctgaatttgatttaattacatcagggcttaaggaaaaggagtctaaactgagagagttcatgaagacttcgttttctaacagtttagcgaaaggtctttcaattcccttgcctctgcttatacgcctcctgctccccactcctaaaaccatacataaaatggtattgtccaatctcttcttagtcttaccttcactaaaggctgtgaactgccttcagaaatatactcgtaaaacttacacagactctcattaggaagctgctaccctccactcccgtcacagcttaactccaatctctttggtcttttaaataccttgtttcctctccatctttaagagacaaatagatatatctttcaagaatgtttcaaatgagaactcataactttcttgagggaattctcttgcccacttggaaaatagcttctctggcaggggttgtgatttccgatgggggcgaagtcacggcttttcgcaactactctgtatttttgttttaaatgtacaggaatctcttctaaagttcagatatagacttatactcccctgacatactcggggggtctggatattttcggaggttgaagcattcatattccatccagtggtttgtatgaaagtagagtcagcgtgatcaacactggacactgggaggtgactcttggacagccaaacctctcctttctgtgccagcttcccccttaggaagaccctactataccattgtcaggaattccggaattccatactcccttcctcaaaacccccctttttcctgaaatccactctcaggaaaacaggtaagctcctttcaatatacaaatgaatcatcagatcttatactctagctttcctgcagatatttgagtaattgcagaaggctaagctttaagttaaagaagttaatctttgtcatttataatagaaaaaaaataaaagcaaatgactaacagggaagaaattaagtaagttattacttatacctgatggcatgttaccaaagcacattgacagaaagtttaaatttttttcctataaaattattaaacatttaaaacttgtagaatattaatggcaaaacatgcttatgccatatgttgagcaaacacaggaggaaagagtataatacgataaaaactatttaaaatgtcacagaaaaagactagaagtgaatagttgcttttgagtaatgggattatggtttttattttaatttaaaacatccctttattattttttgtaacagggaaaaatgtaagtgtaaaataaagaatggattctcaatgggagattttttttaaaaaaccagtttctgcttgaatatatatacatacagttttttttctttctttctttccttttttttttttttttgagatggagtctcactctgtctccaaggctggagtgcagtggcgcgatcttggctcactgcaacctccacttcccgggttccagtgattcttctaccttaacctcctgagtagctggtatgacaggcatgtgtcaccatgcctggctaatttttgtatttacagtagagatggggtttcaccatgttggccaggctggtctcgaactcctgacctcagttgatccacaagtcccagtctcccaaagtgctgggattacaggcatgagccaccgtgcctggccgaatatctttatctactaacacctacactccttatttggtggggaatggcataccagttctccccacatgctttccagaaggctgattgagtggaacacttggagctgatgacttggatttacataagtctcatcttactaacacatcaaggcttttggatttaaacctcttcagcatcctctgtatccctaaggaatgcagtttctgcccctcttatccctgagtatagaggagaataaagctttggcatcaaatcgccttcagttgtggttgaatccaccatttgctagccgtgtgaccctgggtgtctacttaggcaaggaagacaagctttcttatctgtaaggtggtaatctggtgaaataaaaatgagaaaatctatgttaaaaaattcttagcacagattctcaaacacgaatagttacttaatatctcatgactcattattgcactatgcctccaaaactgaatgtgcctcatagtgtgggttttatcaagattgggatctgcctctcatttcttaggatgagatctttcttaggaatacctgtggctctatttcctccttccccaatcatgcctgaaaccttggattggcaaagtcctgcttcattcaaataagccctgggtttgctcaagagaacagtggcttatcttttccaagttaatagaatacaatttaaattacgttttcaccacaaagactgagttaatcctgctagaggctttttccatttcctgaccaatacgatttggcactggaggagactatggtatgttaataacagtattaattgttaaaattcacttgttacaaagttttcattgtcttggtatcattataattttccttttataaggagaatcgacttaaatcacttggctgctctttgttcttcctgtttgctaagcactggcgacgtcttgttttcagcacttaactgagtgcacatctcagctctcacctaaagcctttgccaaggggctaatttccaacattgacagcatcctccactcctgcgtccctgaagcaaagctaaagaaaaagtaggaaatagcaagagggaagaagtaatttccttcacttctttctgagtctgttcattccttcttggaattcagttgagggttaactgtcttctcctttcctgcgaatgcttcacgccgcctcctggtgaccaaataaagccatactttttttgctgtctttggaaatattcttcatggctcctgtgggctgtgggagcaggaagccaacaaaagataaggtctcaaatctcttcaaacagtcctcacacttgctctgctgccaagtcattaagcaagcaaactcctctcccatacgggctgttaacttttatttgtgtagtgctgcttttaaacatggctggcctgaactcttttttttttttctccttgtattgagaagaaactgcccagcatctgctttgatcactgcaatgtctgctagtctactagacttttggcctatctcagatgactctttgaatgtagcttgttttttttgttgttggtggtggtggtggttgtttttgtttgtttgtttagcctcattcatgtattcattcattcaggattcatttttctaattcaacaaatttattttaatcagctagtatttgaccattctagatgttaggtatatatcagggaatatagcagttaaaaaaaaaaaagaaaaaatccttgcccttctaaagctcactgtccagtaggggaagggagctatgcaagttactgcatatagtgtgccataatgtggttaagtgctttggggaaaaagtagaacagggtaaagaagatcagaagaatcaatgggagaggtctatcattttaaatgaagtggtcaggatgggttccattgagaagtgaatgtgagtcaagactcaaggaactgcaggcatgagccaaaaagccccacgaggcaagaacgcttcagatcctgtgggaggaaaccaagacatagaagcttttgttcatattcttggcagtatgagtcattgggggaacacagactaataaagtatgtttcttgccttcaaagagtttatagtctaatataagaaacaggtccaaaataggcaatttcagtagactgtgattgataaaacacttggctaaggatgctttaggggcataaaatggtctgaagaaggtgatattgttaatggcttctctttgtcagcatttgttaaatggccttttgtagagtatagaccactaattacagaaaataagagtcattggggggactcaaatttgtttagcaaggtctatataagttaaatgatataataatatattaaaatttatacattaagcgtaataattaagtgctcaatttattgattatatttatataagctactacatagcaatatattattaatttatatttagattgtctcaataggattaattcatagattgattattttaatgtatggattatgtaaatgtagttcattatgtttatgtcaatatattaaatttttttttttgaggcagagtcttgctctgtcaccacactgcagtgcagtggcgagatcttggctcactgcaacctccgccttctgggttcaagagattctcctgcctcagcctcccaagtagctgggattacaggcgcccgccaccatgcccagctaatttttgtatatttagtagagacggggtttcatcatgttggccaggatggtctggatctcttgacctcgtgatccgcccacttcagccttccaaattgctgagattacaggtgtgagccactatgccaggctctcaatatattaaaatatttgttaagtaatatgaaattaatgtattttgtaaattaaatcattaaataattgataatgagattttgtgtatttaattacattttatataagttaataaattttaaatattataattaatttcactttcattttaactacttttacagtggccactagaaaatttgaaattacacatgtggctgacactttatttctatttgtcagcactggtcttgattcactgaacagatggctggcttcctagttccttacctcttagcattccagaatgaacaaggttaccccaggtcactgagggacactgttgaggagaaaaagttggattcattgagatcaacatacaatgtctttccaactgccttaccttcttcttagtaacctgatgagtacttctcatgcaggggatttagataaaactttcttagactttctgtgtgaactgttagcaggtacatgaatttatgtgattcttcattctttttgcaaaaaaacagtctaagttttacccactctataaagtctgttctctatttttcagccgcttgtggtgttcatttaccattcaacacaggttaagcactgctactgctgattattataataattattattttgcgatagttttggttttacctgcaagaaaactcagtctagttttggatttctttataccgcaacccatggagcaaatgttactcatgtaaaactctcaatgagtgtcttttatctttgctgctgccatttcattacctgggacatttgtgccttgaattgtgtatgaaattctactttaaaacagattcctggtttatatactcatattgatggtctctattttattccttggaagcagttctgtgttctgtttcctctgtccccacccacactatacagttctatcattccattcttgagagtcataattcagcattcccccctgtatcagtccattttttcattgatataaaaatacctgagactgagtaacttattaaaaaaaaagagttgtaattggctcacagttctgcagaccgtgcaggaagcatgatgctggcatctgcttctggggaggtctcagaaagcttccaatcatggcagaaggtgaagggggagcaggtacatgacttggtgttgaaagcaagagcaagtggggaggtaccacacagttttaaatgaccagatctcatgagaactcactcactattgctaggacagtaccaagagggatggtgccaaaccattcacgaaaaaatcatgatccaatcagcctctgaccaggccccacctccaacactggggataacatttcaatgtgagatttgggcagggatagatagccaaactatattactcatgcagccaaacaccctcgctggtcaatctccttacagtgggcctgaagctctgaaatgtttttctggtctgaagattttgaatcttcccttgacagaacagtcaagccatactactcaattttaaagtggctggtgacatccgtatctcctaaggcaaagtgttctagttaatgatttgccacttctgctaggtgtgcacacttaattgaggctctgtatgagtctgatgctgagattagaagtccaaaagtcaccagaaattattacctggcataacctcgttttcttaattacaaagaaaaattaaatatcttctttccttggctaacaaaatagagaatgtatgtgggccataggcctgggaaatttaagatgtgatctgtctgttggattttattcttattctgatccccagacttctcactaaggagagagaagtccatttattagctctggaaggcaacatgattctgtggtaaaagcatggattttagagtcagatacattttaaatcccagcttcattgcacacagctgtgtatcagccccgcatcatgtgtgtgcggtagcacaaggccccatcaaaacaggcagtgcccctgtggtttaatgccctgcagttgctgctttgagattcttcataattttactttcgaatttgtggttcataagtgaagcccaatgggacgctggagcaagccctgggtcgctggccttctcacctcctgctacttccacccctccagggaaccactttgctgctcctccactcctgcccagtcacggctgctgctgctgcccctgcagggtctggatgcaggcatgggaggcatcggggttggcacctgctcccagggagtgtgacattaaatagcaaacaaaagcacaccatgcaggtcaagagggagaccacagaagaaaagaaatagctttttttttttcctttttccataaagcagctgcattttgattttgtcctgggcatcacaaattttgtagctgaccctagctgtacaactctaggaatgttccttagccatttgattttctgtgtatccatcagagtaatggttcaagcagaaaagcaccctaagatatgcctgtgtgtatgtgtttataaatatataaatatttgtgtggatgtgtacttatgcatatatgtgagtccagtgcatacataggtgacataagacttcagagattgtttaactgcttacaacaatagtagtatacctttaccagcacagggcagaatggctgtaagaacttcaaggttgctgaacctgtcactgtggaagagtgtagaaatggaccactgggcagatattccctctttaggggagcacagctactgccacactttgacccagcaggggtgggctggtgattgcattcaccgacttttctcctctgattctctcacctcatgctggtgccttcttctgatagaaaaaggaccagcagccccactgcagggaccacagttgacgtggtccctggaggccagccttccagggatggagtggggtgaggaggttggctagtagatctgtagggcaaataaagaatgcccagctcacctttagcagggttgctttgaagattacataagatgaaataagtaaaaccctttataactggaaagacagaggcatctattattaccgttaagatgattcatctctatggagaaactggagcaagtttgagttcaggtagtgggattggaagagtaaagaaagttctgcggcattcctgattccgtcatagcaccatgctcagaaatggtgatgtcatgttaaggtacaaaataaaattccagtgacacagcctcaaaattagtaacacagagatgggggtgttgcgacatctgggttctcattctggctctgacacctttctgcagaacaatcacacaagtcacttgcctcctctcctcccctccttactcgtctttgagaagggcgggctagttacaggctgcttgtgaggattggagagatatctagaaactgctctgatacaagccacagcttttatgagcgagtcttttcctgggccaagcatggaaatctaggttggtgggtctctgaagcagttggttgtccctaaacagcgacttcatttccggagctactttttaagtgttggtgaaaacacaaataactggagactgtgaagtcttttagcgccgggacctgtggggcagtaacctccaacaggtagagtgaaatgacatcctttctctccacgcctgagtgttcctatggcaccagttgcttgtaatgggtgaagaaaaaattgaactcgtttctcctgagacacacatacgaaagctgactctaagaaagaaaaactgaaatgtggaccatcttatttagttccagttaaagagagatgtgtttaaagcactctgatgtgtggccttaaaaaaggatggggctgcctcttaaggcggaatcacacgagcacatagaaataaaaatcaaagcagttatcatatttaattttcttactgactagattcattttgcattagcaggggatggcgaaggagagggactgggaatgcattatgttcttatttgggtcatttccttgtgctttggggaactttctcttgtcagcgtgcacatgcatgccgggggtgggcgtgagctggccccatgcactcactggcttctttctcggtgtcgtatgacccaggagggagtctgcagcatggggtgattctccacatagagagtcattcaccactctcaaccccgtctccaggtacttcctgtgttcatttgagaagaggcagctgacttaaagcctcatttctaagcagactattagaaaacatgtccgcataacctggagcggcagctcacgcctatagtcccagcattttgggatgccaaggtgggcagatcacgtggtcaggagttcaagaccagcctggccaacattgggaaaccctgtctctactaaaaatacaaaaattatctgggcatagtggtgcacacctgtagtcccagctactcaggaggcaagggcaggagaatcacttgaacccaggaggcggaggttgcagtgagctgagattgtgccactgcactccagcctgggcgacagagtgagactgtgtgtcaacaaaaaaaaaaaaaaaaaaaaaagagagagagaaataaataaaaaagaaaacatgtgggtacaaacaggaagagagagggcgagaggggcatcctggttggagacagctggactcacacatgcactttgtagccactcaccataaaggcagccccaaaggctctgagagctggagggggtgtaagagatcctatcctggaaagctcccatttcatacacaggcagacagcctgtgaggtgaatggggtgacgtggggctggaagagaagggcaagggtcaaaggaaagcattttacctcctttagaaaccatcatgcccccaaacctaaaacttagggaccaccgctgccttcatccatttgtcacctaattctctaatattccagtcttagtatcttttgagcccattttattcttgccctgtctattgccactgccttagcttctggcctccctcatttttcatttaaatgactgcaagtcttcaccctcagctttctaaaatgcaggtccggagactttactgttcttgctatatttcctcaacattcccacaccattctcaagacaaatcccaagggtgtgagcataggacaaagggccctctccatgatttaactggcttttaagactccagttgcaccacattacatatttgccaggcacagttctaagttctttacaaatgttagatcatttactcctcaaataaccttgggtgatgtgtatttttattgtctctacagaggagaaaactgagacacagagaggttcagtgattttccaaaggtcacacagccagtaaggagcagggctgggacttcgaccagacatctgctggcagagtcggtgcttttagccctggcacctgctggtgtggagtgctctgtatgaatcagacccttcctcacctctggcactgtacacaggctgtttcctcactttgaagcaacctttgctcctttctttgcctgagcatattctgtttgtttttccagattcacctcaagtaccacacagtgtctttcataaaacaagaccctgtcttacttggtttctgtgacacattataccagattgaaattactgattaatttgtctgtgtttccccagacaacctgtgtgtctctcaaggttagggacagtttctacctttctctcacttgcaactgaatcatgggggcacggaatgaaggatggtgcaaatggtctttcaattcttgtctctgactgttcagatcagacgagttacttatctctgagatgctttttataatagaggtaaacagagttcttcctacagcacagctattgtgaaaagcaagttaaatgatgactataaacccatagccctggtctggcacataatagatacaccacaaagccccctctgttgagtcagtctggtgtccttgcaatccatcctccactacactcatttttttctaagctcatttctccatctggactcatgcttgctatcaaggatgatctccccacttctaccatcacaattataaaaattcaaatccacctgtccactaagccttccttaactgtgtagctcgctttggtctctccctgtttcctaaaacatattctcagtgtcaacattctctggaatggtccccatcatgcccgctgcccccctgcctgaaaattttgactgtggatttatgtctcttatattctcaatgaggttgtatcctctcaagtgatcaaggctataatttttatttctttaccatatttacaactctaggagaatgacacgtgttctccaaatagtaaatacttgcagagctaaagtgaattgaagtgaattcctttcccaggtactttgctgcctcctagtgttgtggtgaggctccaggctgagagaagtttcctctgagctccagctcagccagcacccttctgagtgatgaacactgttgcagaccatagacctgagacagctggctgcggtttgacacagtttagaagatgctactacatcagaggcctctcttgtccattgggtcccttgtagtggacccctttgctttactcctgaactgagtatcagtagggcatctgtgcagggcttttaaagacttctttcctctctcaaatacctcccttcttcccagtttctgacctggttactgtttggagtttttaattccctctgatcttaaggttatattgcagttcatgttaacattcaaatactattgagaaaaataaaacataaattttccagttatctagattgtaaatgaatttatgatcctgacgagaaaaaggcatgaaaggtacccactctatgaaaaagtaaaatggggccacgttaatgagacagaaagcacaagaagcagaaagccttgtgtatgtcatagattaaccagaagttgtttcggctaggtaccggcagagacaacatggtacagtggaaggaacatggattttggtgtaaacactgaattcaaatcccagctttttcagctgttagctctgtggtgtgttaagtctctcagatcctcagttttgttgccagtgcagtagggcagcgatgcgtagctcagagtgtgtcatgaggattggatgagacaatatatgccaaggcaattaatacgatgctaaggggtttgtgtttttgaaatgcaaagagtttagttttgtattgattcccattacaagtttgctcctgtattttccggctgtctagtccattcacacatcttcatctcttagggaaaagacatggtgtctttaatgttctctgaattagcacagtgcctggcacttagggttgtagtaacaattatggaataaacgtaatgcctacagctaaagatgctgaaactctgtgactttccattatacattcttttttctttctctttttcttttttttttagaccaagtcttactcttattgcccaggttgcagtgcagtggccccaacttggatcactgcaacctccgtctcccaggttcaagcaattctcatgcctcagcctcccgagtagctgggattacaagtgtccaccaacacacctggctaatttttttatttttagtagagatggggtttcaccatgttggccaggatggtctcgaactcctgacctcaggtgatccacccaccttcgcctcccaaagtgctggaattacaggcgtgagccactgcaccttgcccattatacattctttctattctcagtttttatctttaatattttagagtcggagactaatgactcccacatcagcaccccaattaaatagactttttcctgtttatcacctttcctttaatttcctcattcaaagcattattcagttgtcctctcctcttgctgcttaagcctctcaccagctctcagtcaatgctcccagatgcagctttcattgcatgtgatgttgtttaatttcacttgtcttatctataatcacatcaagccatttatttgttaataggctgtttggtggcttcacagttggaattgctgtacatcacatttcatttccacaaggacatcctttatgccggtctgccttatgtggcattcgtctcttcctcttgccaggctgggccagcttctcccgctgtaccttccacatcagctgttcattttccccctgctgctgtcactgataatttccaggttaaatcttataagtggaaattggatccacagctggagttgaaacgcagctccttggagttattaccacagtctgttcccgggtaggtgggaaagttgaagatgatagatttccagtgcctgggaataacaatgctgtccctctaaccacaactaaggtgagattactttcccctggggagagcgatatttttaccttttcactctgagtttacatcagggggattcaagagaggcgagtggtttttcagtagttttctgttattttatgagagatgagttaaagtgataatgtaggctggacagcaaataagttataagtgattgaccagccttttaggctgtcagctatctcaaatagaggctttctttatttttttttccacagtagaaacatttgatttatttgattcaaacagtagaagtatgagaggatcaaataaataggtttgttcaagaaaaaaaaatattttagtatttcatgctttcaaagcctatgccataacctttgaattattcagcaataattaattcaacaactatttactgagcagcttccactgtttcaggattggaaatatcagcgcaatagatcacacaagattccatctttttgaagctgggcttctagtggacaagactgataataacaagacaagatacataagatgatttccaatgtactaggaagaaaagaaaacaggaaaatgtgagaccatcttgggtgagatcatcaggaacaacttttcataggagagttgatgttagtgaatccataattgctaaaggagatttgagtaattaaaaggggtccgggttgatctatatctctatttcttttctctccatcccatgctttcctctctgacccaccccagcccctagtaaccatcctgaggtcagaaatatcaagataccttaaggggctttctccttaagatgtcaacaacatccactgaggactgaatagaagatgccagcgcttggctcaggtgcaggggatggcaagagctgagctctgggctgtgaggagttctggttctggtctggcctcatcactggggctgtgtcaccttgggcaggtcttgccccctttctgggccttagccttcattttcatttgtgaagtcagtgtgatcagatgatgtatgaaatttcagaatcgtatagaagataacctacctattaccttaaacagtccgcgtgggaggagaaggtagcaatagttgacatgaggttgtgagggatcaaaatgaggctctcagtgctaccctacacccctcaactttgtcacactgaatctgacctggaaggtacatgtagggacagtttcttatagagaacacactatctaataagtggagacatggcatgtcctcaaaacatctcccttattgcccattccgggctttaacatctgccccttccaattactttgactcttcaaaggttttcagtgcaccttaaatggtttgtacatcttctgcccccttggatacaacagcatgcacggacatttgcttttctgattaatccctttgctaccaccctcaactcaaagcattacaggtaggaaaatggactcaaagatatacaggttaataaagagaagaggggaagagccaggagcacaagcagtgtccacgggctgctggtcccagccagtgagtgagcaaacataatggacctgggcatcgaggttgggagaatgctgaaaaagaaatgccaaagtcaatttaagccatgttatcctatttcctgggattggtgctgggtactgaacagaggctctcagccaacccctacctcacccagagcacagtatagagtatagacactgtcttgtacacactcagaatacaatagtgatgtgtttctgtgtgcagccctggactgtgtgaagtggcttctcctggacatgtcaactctccttgcttgtggcaggacatcaaaattggttagactgaaagtgtctaatgagctactcccatatgccaagcaccattttcagcaacagggactcagcagtgaacaagactggcaagatctccaccttcaagggtcttatattgtagtggggaagacaggaaaaaataggcacataaagaaaagcaaatcaatacatttcagttgctgatgaagaatgtaatgtggataagaaataactgtatgggtatttgtgttgctttaccctgcatgattgggaaagtctctctgagggatagatatttgagttcattcattcaacagagataattaagtaccttctatgctgcaggcccttttctaggcagaaaggattcattaatgaataaaccaaacagccccatacacagggagccttctttcagcaagaagagacaaagaaaaaatatttaaagtgtaattttttataataggtataataaacttcatatttaatgatgtataactgatatataggaacagtaatcattcttattgctttattgagcaatgcacatcatatataagtgtagttgtaacccaaatactaagagggtggagccacttaaagatttggataaagcacgtcccaagaagaacatagtatcctcaaggcacaagtaacatcctatgtgatggaacacttgggccaggaaggcatggatgggaagataagaggttgaagagagagccaggagccagatcatcaagccttgatttcatccaagtttcaagggaaaagcctgggaaagttttaaggagatggcagaaggaattggagagatctgatttaaggtttagaagattctctctggcagttggtggagcatcaacttagggacaagaagggcagcagggagatgggtgagggagctgctacagaggtctagaagagagagggtggtgacttgaactagggctgtagcaggagaaacagtgatacatagatgatacatatatatatatatatatatatatatatatatataggcaaataatagatgatagatgagtaaatagataatagatagatagaaataggtagatagatagatgtagacctgacagcgtaactactgaattggttgtaggatgggaaggaaaaggagaaattaaggttttcccctaggtttggcctgaagagttgggtgaatgttggggccatttatagagagaaggaagactttgtgggtagtgaagagggaatttggaggacacaagtaaataaatagctcagtgtgagccttttacagtttgactttatacagtatgcaaatgaggatgtgaagtaaatagatatgagactacagttttgaggagtggggctggtatttggaaggcatcagtggtgaaatggcatttaagctagggggaggatgagagcaactaaagaaagtgtatacatagagaagaggtttgaagactgagttctgggacattttcagatttggaggtctaatagatgatggagtcccagcaaaggagggcaagaaagagtggattttgacagaggaagaaaactgagtgtagcatagtaaaattctagattcatgggaaatgttgctgaaaaggtaagatgacagagaattaaacattttccttgagaagggatacagttaccgattacctttaaagagtgtggtggaggaccaaaaccaactggagtggggtgaggagaaaaaatagaaattagggagtgtcaacagatagcaaagacagcttttttttttttttttttttaagaattttgcttagaagtagagaaaagtgctatttgttggatctctagttggagtcaagagttaaaataaattatagaacaatatgtaatcataaagaggtgagaaaagtgtggatgaatgctgtggcttcctttttctctctagtagtagtccctagttggtctgcaatgaacttttgcaagaacgagagtggggaagactcttcatgaggctgataggctgtagctctcatggtttgtctttaacccacaggtagtgagcaagccatttgctctcagggaaaatgtggctttcctgacagccccagatgatccatctgtctctgcagcctataggtggggcatattggaaacaaagcatttaataaaatgtaatagttgtgactcgggacatagaagaggcagattgaaagagaagtggagaccaacacgccatctttccacataaatggcttcagaaagctgcagactcagagtggatttgttcgtgcaatcctcacctctcctactagttaacaagtcggcaagccagcagtgagggtttggtttgtaccctcagttattaaccattagtatttgtgtcatgtgcttttgcctgggaaggtgtccagagattggagagtagtgttcagtcttcagtgggtagaaattgatcaactgtagaaagaaataagttatcatggatatgtacatcagctgtgtcttgtttctaatggctcggctcgcgactagctgaaacaatgaaaggaaaaagtgtgggtaattttcaagtaattgatgtatttggggctcatgtaggccacaatcatgatagtcacctaatttgatccttatctcagagccaaatcttctcacagagttgttgacatgggatgtattttgatcttgattttggagtcttgaattctttttccaaatgttcattcttctccctctgtatgtccctcagcactagattttatcatcaggcacagaacatctttctgagtaatctcttccatactccaggtggcgaattaaaaactatgtgaggatgactggaagtaaaacatttaggcagtacttgctgctctggagacattcaaagaacaataaacacttctaatgtagtatttactgacctccagaagtgatagctgatagtgaagacagagtgcccgggcgctccaggctattgctccatgttgagattggctgagaggtcttcggaagtcctcagattgaatggtagtttcactttaaaccaagcaaaaattgtcatcaaaattcatgactctctcctaccccagctttcctccaactaattgggctctctttctggtcttgaatgcatcgagtttttatttgtctcagtgcctttgcactttctgctctctctactacaaagcccttcccagggccctacacatagttggttagcacattctcgtctttctggcatcaacttaaataccgtccccataaggagatagtctttgaacaatcaatttaaagtaatccatccatgccttttattttctttatgacacttatctcaactttgttcattttgtgtctcttccatcaaacaaaaagctcctctaaagcagaaattttcatccttcctgctctatgctgagtgcccagcccaatggcagacacagctgacactcagtaaatatttgttaaacaaaatggcaagtgtgagtgctgtagagtattatatgtttaaatattaatttcaaagatttttaagacttttgttgacttcttcaacacattctcctcccatgctataagcatctgggggctcttttccacctcttccctctcccatcacaatgtctgacacataacagatactaaacaaatatttgtggtatccatgagtgattccaattaatttgtattgggtatttcaatatagtcataagtacatctccatgtccaagtatatctccatgcccaagtatatctccatgtccgagtacatccccatgtccaaatacatctccatgtcgacatacgtgtccatgtacaagtacattcaagtacatccccatgtcccacatacacctgaggataccgaagcttagtgtggtgggcagaataatgccccttcctcatagatgtctataccctagtccctgggacctgtgcacattgccttgtatggaaaagggattttgcagatgtgactcaggtaaggatcctgaaatggggggattatcctggattgtactgttaggtacaatataatcacaagagtccccgcatgagggaagcaggaaggtcagaacctgagaagaggcagaggtcagagtgatgcagttgctccctggaggacacaagtgaaagaatgtgaacaacccctagaagtcagaaaaggcaaagaaatgaattcccccttagagattccagaaggaatgaaatcttagtgacattttgattttagcccactgaaatccattttggacttctgaccttcagagctgtagataatacatttgtggcattttaagcactaattttgtggtaatttgtcacataagcaacaggaaactcatacacttagttcctcacattgaaccctacccactctagctctctcgccatccctgttccctattagctagattccccaattcacacacctggaatctccagagagggagttctagagtgtgggactctcccaccaatctgtgtggatcatgagtaggtagatcagagatccatggaaggccatcaagaccatcagtggttggagtaggtcatgaacgtgatagggccttgagggtgagtagttactcctctcccaatttggtaaagaataaacttcttccaggaaaatcacagatattgtcatagactgcaagaagaaaaaaagcaaaaaaaaaaaaaaaaaaaaacaaaggaaggaaagaagaaggaaaggacagagagaattatgactgtgttgtgtctttctctgatacacactcctggagcttctccaagcctgtacttgccttctatgccatatgcaaatgctgtagaatgatttctttcagtgctaactttatttaattctatcatcatggtttttactttaggaaattttggttccaatagtttaagaataacatggaactgaccttagaaattgtctaatccatattgtgactggcattatgaaaaagctattattggtgaaccatggactgccctgtgggagttgggaggagaaggagggcagaggggcagagtggaagaggagaagcattcacagatgaattcaaggtctttgcataaatgtgaggtttcttaccactataattttttttaaataaaattaaagaagcaagcaagcaaacaaaacaaagagaagatggttcctgaggacaggtgttttatctaagacatgttggatgcccaggatctccttattaggacttaggatattaggccacagaaaccaaagatttgtgagggagaagttggggaccagtgtcaggtagtcaggcctttgctggtaggaagatggggcttacataccctatagccacacaggcttggcactggtcctgggtgaggagagagtggggcccaggtataggccagccaggcttccccagatgatgcgtctgtactttccagtctcactctgctcccctcaccacctctccacacaagcctcagttctcagtcactaagcagcattgagaggcaattacagggtgcagaactctgcccgggctcctggaagaaaagaatatgtgccatactgtgctaatgcaggctcttctatcatgcctctaataaatgggttcaataaataaatgggttctataaatgggtccacaagcgtatgtttgattcactatacttcatgttgtcattttcgctggctccttggggagaagtctcatgcttcagggaaaggcacgattcaccagaagccccacctcaaacttcctttttgtttttgtttttaaaaatgaacttttgtgttctcacagctccatccagcagggaatcctaaggaagctctgaggagagccacagcaccccctttctcctgcctgggtgtctcctgtccctccacaccagctccgtccgctcctttagtttggaatatttccttaacagacctgtaggctctgcctccctactccctcctaagccctcatccgcaatccacatgtctgacctctccaaatagattactagttcagttggttgctggacatcttagctctcttgctatccatatgatattggacaaggagaaagacagggtttttctttgttttttgtttaaggagaaaagtgatataaatgcccctagtccttgtcaagttttatgttattatcctttcctcaaaatagagcacacatgcacacaccacatacacataccacatacatctgcacacatgtgcacataaacacccacacacgtacacaccacatacacatacacacacgacacaccacaaatacatgtgcacacatatacagaaagtttttgctgtagatatgtcattcctttagcaactattttacactttttggagtcttctctcactattagaaagagctttgcggtttacttttagagaaaaaatccacctcctcctttagcatctagtcatcagttgggagacagtttttttttttcccaattagaaggaaaaaaattccaagtctattttagaaaagaaataaatattctctttctcaaaatgcattttcagccaaaatatgccatctgggggatgttagaaatttcagtcagtttatctttataaactattgaagctgcacctgttataaatggcctctgacacaaaacattctagaaacttcgaaaacaacattgaacatgacttcttgactacagatttaaacttatttcatcatacgtgcttcacagacagtgagctataaggtgtttaattagggcacagcagtcatttaatttagcagttaaataacttcaactaagataacgggttaattttgaggagagtgataaactccactccctaggtcttgttttattggactatggggcttagcccttagcactggattggcttgggaatttatttactgatgaattcaaccaatattacaggtacttttttaaaggcagtcagctgaaagttggaggaaattctgtttcagattctaagaaaataaacaaatctgctcaccttccactctatgctaccttttctattttgagagaataaacctctaaatctttagacttttatgaagaacacttaccatcatttgaatgtctctcttcatttccagtctattctgaaagtatcttcctcccaccactaggctttagtaaatatttataacccaatcatctcaagtccattggactccatcactggtatgtttcaattatttaaagtcagaatagcatcttctgggcagctaatgacgtctcaatagatatacattatcgaaacatattgttatttacttaataaatcaagcctgttggggaaagtagatgcaattcaagtaccagaaatgaggaataatgatggcatagatcatttctgaatcactctagcccattttacagcctgtaaagtacactgaattccataaaagtgacaaatggtacaacattgtaataaatagctatagtttgtgcattgtgaattggagcttagattcatattgaaactctctgtcaaaaaagaagaagatgaattaagtattaaaatcatactctgtaaaaggaattatatattttccatttatcttgatttattatatgacatcatgtgcttaagtatatgtaacctttccaaattgagttgatttaatgtgaagggaaaaaatgttaaaaaagaaaatttggtgtatgtttagaattttctttattttcctgctatatttttataaaacttttaactgttccatggaagcttaatcatattacattttttaagttgaattcccagaaatatgcaataacatctacagggcttattaagaacaaatgtgctaaatcacaattaatatgactgtttttcattcaaatttcaacgtttgcatattaagaacacataaaactggctgggcgcagtggctcacgcctgtaatcccagtactttgggaggccaaggcgggcggatcataaggtcaagagatggagaccatcctggccaacatggtgaaaccccatctttactaaaaacacaaaaattagctggacatggtggccggcacctgtagtcctagctacttggaaggctgagacaagagaatcacttgaacctgggaggcagaggttgcagtgcactgagatggtgccactgcactccagcctggtgacagagcaagactccatctcaaaaaaaaaaaaaaaattccaaaactttcagtgaaatattagctgtatgaagagagtgactacgctgaagggtgaatctagacttccaaaatgacagaccgaggaatgggcatgccttgaatttttccaaatttcctggaatttaagtgatacatctaccgttctatttatcattgaaaaataattcttagaggaataagcacatgtaaacaatattctattgacatctgctatttactccctcaagttaacaatacagccacaaaatgattaagatgaacaaacccaactcttactgcattgcttcctaaggagatgaagtggtttttcttaggcatgtgcattggctccattttttttaaagttggtttgcagcacacttcaggaggccagaagctaaacaagcaagtgtgagcgttagcctgtaggaaagacaaaggcacaaagtgaggaaaagaaatgtgtcttggtcaccctcacctttcccggtgtccaactgacattacaccatctctctgtcctctgctcatctgcctcttgcatgttgcattcttgaagctttcctctgtcattttgctaatttctgggatggagctcgcagctcacccgctgggatagcaggagaatgggtgtgaagtatcaagggctgggttggccacaatgtcctccttcgccttccagcaatcgattcctttgtgctccattttttccaagtgtatcaaatggatccaacgctgtcctgtgcggagtaaaagaggtattctaatgatattctaatggtattcaaatgatattctaatgggaggtgtaattttatgaatacttcttgcatctcatctccacaattaaagcataaattttttggtttgaattctgtcaacagagactattcactaggccccttctctacacaaggctaagttgctatatatgtcctattttatataattatctaaccaagcagaaacgtaaatatatatcttcatttagcttatgaaggaaataatttccaagctcactaagaccatagcagaggagaaagactcaagaccatggttgtctgatggcaaagcacctactcttccccctatttcatattgattctcattaacaactaaggttatttagaaactatatattccatgatataaggtacccggcagatcacaggccttcataaaagttttaagttaataaatcaaccactgagggaaaaggttttttctctgaagtcctgggttttccactggtaccaaggtattaatagtatcttatacatagtagacataagggaaaggaaaatagaggagaaaaggaaaaaaaattggggagaaatgaggtagatgagtgaaggaagatgaatgaaaagaaagacaaaaggcaaagcagggaaggagaaagaatatctcaggaacgatttctgttccaaccattgataaactggtacaaggagtctactgctctcaggctgtggtgcactgtttgttttgtttttgaaattataatgaaagaagagagagatttaaagatcttcactcaccagaaaagttttgtctcctttcatccattaataattttatttaatttcaatcacttagagtggtgtggactaaggatgctcttattgccttcagggaacactgcagaggcctggaatgagttatataagcaatatacaagcaaatgtcaagtgtaagcctcctctaagctcagtggggcctcgtgatggaggttatagcaagaatggctgtgagcctctggttcaagaagggctaatcctggctgtgttcctgttctgccaagacaggaactctgtcactatctccttagccttagtggactagagcattagctcttgtattttcttttgcacaacagctgctgggcttctcttttaggcctcaaaatgcctggtatagtgcgtgacatgaaataagtcctcagcaaatacctattggattggattgattaagtgggaaagaatggagtaatggctttgtcttaccacattgcccacctgatctgttctttctttttgtcccaagcacttaaagcattcttattgagtcatggtgacaagctactctctggataaggcttcttgaaatggattttagtcaagcttagcaccaacggccattaggaagccaacaacacaacacatttctcctctgtacttcgcagattatttagtgaactcagccatgcttcccttggaggagtgaaaacagacatggaaactggggtgaggcacacagcgcagcatacttctgtcctggtgtggacctctgcatgaagaaatgtgatgtgctaaataaattcctatccccaggaggcttgtcttcttatctcagacctgccacctataaactacgtgacttcctggtgttataatttactcttcttgtgccacagattccttgtatttaaagtggatatttgctaagtgtctgctatgggtcaggtgcagtgctaggcacacatggacacttaactcatagaatagattcattcattcattcattcattcattcaatgtatattattaagtacctccctctgtgttccagacactattctggttactagaaatactgcaatgaacaaaacagataaaaataaaatatctttacccttatgggggtggatgtctataattcagacatatgagaaatggactctgtgttcagtagccatgaatactaaagagaaagagaaagcaggcgagggagacacaattttcaggggttcaggttcaattatcagaagcgttttttccttatctcttgtctttagatagcctgcttgggagacaattcactgagcaaaccatgccactgtcaggaagaacattctgggctcagggaccagcaagagcaaaggagctcagccatattaacgactgtgccaggatattttactacacagtgaaaaacactgtttaaaataatgaggcattatcacagaaaaagaaatgatcacatttaaaaaaataaatttgtatgtagaaataattttatatgtgcaagaaagttgcaaagagagtgcagagagttctcacatgctcctcgacatcttcttttcattagcattttgcgttatcatggtgtatttgtcaaaacggagaaaccaactaaattatgatcctgctggtttctccactaatgtcctttttctgttccaagatctaatccataatacaaaattatattcaggaaagtccattttaaacttaggtgttaagttttatttttaattctgattgaatgctatttccgtgtaccaggtagcagttgaaaggcagttggcaaatacttgttaggccaccaagtctcccttaagtgagtcacacacagcaggaagaacaccaggcaggtggtctagagtcctgggtcttcatcccagctcttcctcaaccaaacatgtgtccttggacaagttttcctctggagctgaggcagatttcttctgtacaaaatttagaaatttaggttagatttgtaagatccctccaacctcttaaattctgccctggcattatcatggcatcagtatcttcatactcagaagcatcaaaaattatgtgactgatttccctaatgccaaacgttggttcattacagcaccagagtgggctgagagagcttcagcacaacccttgcctctgactaccatactccactccaggctccctccttcctatctcccatcctccaacagctggctccagacagtaggtgttaacggctgagatcactaaatgaataggaactattcttagtattttacttgtatttcttataaacacccttatgaggcaggtacaatttttttggcttatctatcttggtagacagaataatagccccctaaagatgaccttgttgaaatcctctgaagctgtgagtatgctgtcttacaaatctcacatctgcaaagggattttgcagatgtgatcaaagtaaggatcttttttccttagttggagattagaatatggggagattatcctggggagatagggagttattctggtgggactgatataatcataagggttgttttaagagggaggcaagaagtcagagagcagaggagaggctacattgctgattttgaagatgaagcaaggggccataagccaaggaacgtatgaggcatctagaagctggaaaaggtaaggaaacagattctttcctagagtcaccagcctgtgacataataaaattacattttttaaagctactacatttgtagtagcatattggcatattggtttctacattagtagtaatttgttacaacctcaataagaaatcaatatgcccatgaaagttaaaagaatgtgtccagagctggaaggcattatcctcagcaaactaaggtggtaacagaaaaccaaacactgcatgttttccctcagaatgggcactgaacaatgagaactcacggacacaggaacgggaacaacacacactggggcctgtgggaggtcggggactggaggaagggagaacatcaggaaaaatagctaatgcatgctgggcttaatacttaagtgatgggttgatcggtgcagcaaaccactatgacagatgcttacctatgtaacaacctgtacatcctgcacatgtaccctggaacttaaaattaaaaaaaaagagagagagagatactgtaaaaaaaaaaaaaaaaaagtgtccaaaattgggtaactggtaagtggttcagtctagatttgagcataggccatactgcttcactaatgtaatgaaaaggccttccccatagttttttttcttttattgatacacactattttatatatttatgggggcacatgtgagtgttgcatgcatagaatgtatgatgatcaagtcagggtatttggggtatctaccactatgaatatttatcatttctatatgttggtataaagttctaacttctggttactttgaaataatcaaaatacgattgctgagtatagtcactcgtgaatggaactggaggtcattatgttaagtaaaataagccaggtctataggctttttgtgatgcttgaacgaagtacacagagaatgcaatgcttagaacacacaaatatcattgagttctgtagttaccacaacaatttgtggctctagtccacgatttctcaatcctgtcacactcacccacccatcccattatcgcctcaatcccgagcctctgtcctcggatctgacctgtttgacttttgtaagacgacaatcagaattacagtgtcaaaaatgacctcatgcaattgtacagcaacttatgctattcaccttgcataagtaaacgcgatcatatttagttttgagtcaaacatccttgggaatgagttaaagaatgattcgcctttgctgtaggtgtacctatccctctctcttgctctttctgttcatttgccttctgcattctacctattcttacatgtttgtctctgtatcaccaaatctattttggtcccttcacttcagcctatttcttgtttttgtagcagtccagaacaaagctacaatttattatttaatacataaatagaatttatgtgtttttaatataaagatcagaactgtaggaggttttatattttccttaaaactccaggcaaacaagatttttgactaaattgcttttttatatatgattctgctttttctcatcttatatgttaatagtcttgggtatgaaaagtacttaaatttagagacatggtaatttagagacagaggcctggtttagatatgctgactttttaacactgagaaagtctcttagagtccctgaagatgaaagtgtagattttagttactaattcacctcttgtgcttgttatccatatgaggagctggtaagggacaaatcctgcaagagtgagaaaaagcacccatttttctatttgctctacatttgggcttaaattgctgctaagtcattccccgagggaaatctggagtgagtgcatgttacaaataaacactcccaactttgctttccacagcctcagcattttcagctccataagagacgctctgaacaagcaaatgtgcttttaacttagctctaaaatatgtcctgataggtgggagctatttttaagacaacagcaaggacccggcagactgatatttgctggaacccaaattgcctcacatcttctctgactttgcccaacaatgaggcccatcaggttattattgtcccctgagaaaatatattttgcattgcactgtatgttactgctccccttaaagatgttggacatttttaagctgcgtaatgaggaagagaaagtgggtggcaggataaagaagtgggaaaatggtaaagagtcctgcatgagaaacaaagaaatctttgcaaagtgaaacaagagcaaaagagtaagataatttaaactagagtgataaatcacactcacacacacacacacgtgtgcacgcctatcaacctatcagccatctgttaatcaattatttattaattatctatgtagccatctatgtcaactgtcaatcaatgtatcatttatttatctgtcaatctatcatctaccatgtaggaggcaggagggagaatgctatatttgaactaaagcagaataaaatagtaaaactagtctctgtgtttcttttgtcaaagagggtgaatatgccatgaaagtctaatgggggatgagaagtttgtctccttctcttctttcctctcagcagcaccccctttcccacttcaagtcctcctcaaggccaggtgctatatattgaaaacagatttataaaaactattcaaaatattcctgagagaccaggtttgtcaccaaagacttcccaaatgataacaaatcattttgttatcatattctgaaaagcagaaaatgtggactggaagccaggaaacctggagtgtagtctgggtactatatctcactcaaagataaatgggaaagggcagttctccaacttcaatatcaccgtggggcccccaaatccaaccaacatatctagaagctgtctgactagatgttcgaatataactcaaaacaatccaacataagatcccttaggtaggagctttggcaatgtgtccacagtaggcagaatgatgggggaacttgaaattatgatatgaaaagtagatgaaggtggccgggcatggtggctcacgcctgtaatcccagcatgttgggaggccaaggcaggtggatcacgaggtcaggagatcgagaccatcctggctaatatggtgaaaccccgtctctactaaaaaaatacaaaaaaaaaaaattagccgggcgtggtggcgggcgcctgtagtcccagctactcagaaggctgaggcaggagaatgacatgaacccgggaggcggagcttgcagtgagcagagcttgcaccactgcactccagcctgggtgacagagtgagactctgtctcaaataaaaaaaaaaaaaaaaaaaaaaaagaaaagtagatgaaggaattagagatgtttatcctggaatagaaaaaattcatggatggactatataaactctgtgaaaggctgtcatgcacaggaggaatttgatttgtcctattctattgtaaactggtggttctgacacggcttccagggactcatctactggatcatagttagacccataagtaaaaatgactgctagctgtatactgcttaaataagaacagtttggggtgatacttgattttgtttggattcgtgcccccacccaaatctcatgttgaagtgtaatctccagtgctggagacggggcgtactgggaggtgatgggatcatggaggtggtgtctaatgggttagcaccatcctcctagtgctgttctcctgagagtgagtgaatgagtgagttatcgtgagatctggctgtttaaaagtgtggtgcctcctcactctctcttcctcctgctcctgccgtgtgaagtgctggcttcccttttgccttccaccatgattgtaagtttcctgaggccttcccagaagccaagcagatgctgtcatgcttcctggacagcctgtggaaccgtgagccaattaaacctctttttataaatcacccagtcttgcatatttctttatatcaatgagagaacagactaatacctttaacatacgtgtaatgccatcccctttctctcatgatatgccacttcatagagggcagacgccaccgctaaaacttatggagggaaccagaaagtggtagggtacgtctctacagaaaaatgtgctttctattgatgaaaattctgacaattaattgaattgctgtggtaggtagtaaactctgtcacttaaggtattcaagcagaggtttgaatgaactctctgtcactcaaggtattcaagcagaggttattaattaatataatacaatatttatactacatatattgtgtatatattctgtatatgtagtatataatatttatactacatatattgtgtatatattgtatatatatagtatataatacaatatttatactatatattgtgtacatattgtgtacatgtagtatataatatttatactacatatattgtgtatatattatgtatatgtagtatataatacaatatttataccacatatattgtgtatatgtagtacatatataatatatacagtatacatattgtattatattaatgaataaccactaccatccaaatctgtctctcacatacacaaacatgtatgcacaaggaagaaaataaacatcatgaaagggcagggatcctttctcattataaaaataacatcatcttttgtaaacaatttaactttcaaaagataatacagttggaagtaaccaaattgtgactctatagttaaatactttgaattgatctaataatatagaatgtaaggtgttacctagatgagtatgaaaacagaatgaagcaaactcaccaaaacatgaaataggccccccaaaataatacaacttgtttatgggaaagaaaacacattgtgaagtagacgaaaagatcgtatctatcattctataataatcaccaaaattaattcctcaaaatctcagagttggtagtggcatgaagataaataaatgcctattagaacatgaaaggttcagaaatatgagaaacatgatcagaagaggcagatctctccaccctattcaatctgtccagctcccgtgacatgtgctaaatgagaactattgtgtgagctttcagggaaaggagtaaacctacagcgaatgataaagtctccagatatttgaggttaatgaaggggaaggaggaggaaaaacaacatttgtggagaggctacatgtgccagccatcgtgataggcttttaaaatgtgatatttctcaaaactggtccatggggatgacactgttatctcttcttacagatgaagaaactgaagttgagtggtcatgctgagattcatatcacagcttttagaagcaaagcctgtgctctttctactctaccgttctcgagaatttaaagtcgtgtagaaaacacaggcgtggaacctataatatttaatggacaaacaagtgtattttactttttcatttagtctttgtttgtttgtttatttctgagacaaggtcttgctgtgttgtccgagactagagtgcaatggtgtgatcatagcccatcgcagacttcacctcctgggtctaatgatcctcccacctcagcctttcaagtagctaggactacaggcacatgccaccatgcccagctaatgtttccagtttttgtagagacagcatcttgcttatgttgtccaggctggtcttgaaatcctgaccacaagcaatattcccaccttggctttccaaaacattgtgactacaggcaagagccatcacacctggttatatttgtgtttcagaaattaagaaggtttgagaaaaaataaataaatgaaagatcttcatttggtcaagtccaaatgaagtcataacttacaggcatcttggagtgtgaacaaagagaaagcaccgatagttccacacaatcaaaaggggatttggaaagatgatcctgaaaaaaacacctgggcagggttctttataggtcactttgcagaacaagagaagtacaaggaaaagagaaagatatggtcccaagctatcaaacgacgaagcagaagataatccaaaagcaggtttctcagctcaggaaagcaagaacatgaacaatctcttcaaagggaaatagatcttgggccagctcacctagttcctgagttctagagagttttaagggctgctaggaaagctgtcttgatcttgttagggcactaccctggggagaaaacactcacatatggaagaaatgcaatagctaattcttgactaactgattgataggatgggaacaatgaagggaatgagggtgagaggcaactaatattaactaaaaagtaattgctgtcttttcatcaggagtctgctgcaaaggttgccttactgcaaacaaagtggctgaaaacagataatcctttgctaggacatctccacttttccaaaggatggaggcatcaaagaatgattactacatttgatcgtggtgaaagaggaatcatgactaataccaagagaggctcaagcagataaactgctgaaagaagtatggcattttattccaagtggatcagaaatatcctgttttatgcaatgatggggaagaaaatgaaagactcaggacatttctgggcaagggacagtggtgtcagtgagaaggggcagaccattttaccactttatattacccgcctcatgtgactagacccagtctgcaagcatcagcactgtgatccaataatctgttacaaaattcataggtttttccccctcccattcaaagttcccctgggaccccctatggaaagaaataggaagaggagagcaaaatctccctctctagcagggtcagcatccccgccctgcacagcgtcagcgccgcttgcccaccactctcctaaagacccgtcattatgaaaggaaaagagaagctaatggctgacttgatggaaacattcttggcactgtggacaggcctgcttggaggccctgtctgctgagccttgggaatgtgaagaggaaaggtagctggttaacattgtttaacacagaattaagtcataatcgcacctgaggcatattccagatctttgtccccccagcacctgtcacatttgatttaaagatttctcaaagtgaaaaatggtctccataagataaagacaactccccaatagcaaccgcaacacaaaactgctacttaccacgattttccagggaaacaaggaaaagggctagattatacagcaagcattatgtgagagaatgcaactctttttcttatacatttgaaaacattggagggaggcagtgaaagtttctccaagggctttactgggagaacatgaagtgctgggagacccaggatttccatgagtccattgggcagggcacagcgaggcaggctgcctatgtgggttatacctgctcttaagtaaggcaatggaaggtaacagaagccaagaaacaggatccataaactgaatagttctcactcctcaaagcccaactaaatagcaacagcagggagacgaaggggcttgaagaataaagatgaaaaatgcatgctccatttattagtatttgagttttcaaaagttgtatgaaaagatgggaagcaatgggacatttgatgacgctgaaaatggaaagtggggatttcatcggtaagagtgattggtgtgcaatttaggagagaaaaccgaagaagaaggaagcaaaagaaaaaaataaagacaggagacaaaagaatagctggcattagaggggaaggctgggctggcatgtcacaggatcatgttccctctatgttgagatgtgggtggctcagtctctggggattatattcataacctatatagaaaaataaggcaaagccaatcagaaagggcattaacctctggaagacgaggatgtggatgaactatatgctattattgtttggaagtaatgcatttgcacttcaactttaatgacagaggatgacaaaaattagaaaggtagtttctagtcttttccactatagtaaaggactgatttcttatagggaagtaatttctcctgacacattatattaggtaaagattgcatcttatatgaattaatacatttaaaaacaaagagaactattcacctttttttgatttgtttcagtttaaggggctaaaatctgttaatccgctactatgtgctgtctcctttggttattttatttgctcttaaccacaaatttggggtggtagtcttctgagattggtggaaaactcatgattttctcaaagtcatggtgttcatacaaacactcagaaatcaccctcattgggttcagggaaaggtaggcaatgtttcattccaagcctggccactggctgattatcatccccaccccctccacttattctgcctccagacaataaacttaaaggtgaaggcagggaaaggggaatgaagagttcaggaatatcagagatgcgtgatgaaataataacagatgaactggtgattatgatatcaaaagcaccactacaattgttcaggatgtaaaagaactaggataaagtaaaacttctttatcaacaaactgctggttacccccaatgtagagttataaaaaggaagagatggcagtgccaagatggtggtggtgggatatcaaagtcctaacagtaaataaatggcacattcagtgagcttaaattaagagagttatactgaatggactgtttacaaacatgtgggaagagttagaggataattaaacatccagggaccagtaatagtgagaaatccaatttttcaaggggcagagatattaaaaagtgattatcacatttgtttgtgtcactacctgtggtcttgaagagggaagaggagggaatcgtagtactggaatttaatgagagctattgcaccaggagaaaggtggctggaaaggagctacattcttagagggacacagtgaaaatctgtgcctggcaagaaggaagcctggggatggggtgaacaaatacccctatctctctgtctctctttgatccaaccttgtggttttcttacagggggacaagggactttgagtaaacagcccacagaaatcaccctctttgggtacaggacaaggtagggaagagtggagaaaaagtctggagtggcaagcaaacaaacaaacaaacaaaaactagcccacaggactgtgactgagctaattagcacaccactccttccaggccaccctacagaagccaacactaaacaaaaacacagcatctgctctgcaagacagactcaagatatgttctttggcatgtctttccaacaaaattactgcctctgggtcatcctgtgtagaaattctggagctaccaatgaattgggaagagtgttttttttttgtttgttttttgttttttcatagaaggatgagtaaagaaatttcacttgttttagacaagaggaaggcaagaagacatagttaatgggtacggcatggtaaaaggagtacagaaattaagaagagcaggcaaatagatgtgatggagaaaaatatatggtatgttatcaagaggaaagagacagagaacaacgaatcatgatttgggaataaagttggcaggactgcagaatggtgatatgtatgttttctccctcatctgtgcagcagctttcaacactgaattaggaaaaaatgtggatggtgatgtatattactttatttacacctcacagcaaccttgcgagataggttatccccatcttataaatagggaagttaagtaatttgtcaaagagcacacacttggtgatagggaaagccaggaaccaacctcgcttttgtttgtttgtttgtttgcgagttcccttggccaacaggccttcctgtagagaacattgggaggacatataaattgaaagcagagtggaggtggccagtatcacatacctgggacccaccggactcatgggcttccaataagagtaaccagaggggtccatagaaagtcagagctgctgccattgatgacgaggccggaggggctcttttttgccatactttcttaaagcaccatggccctatgctcttaaacatgtctctatttttttttaaagtaacaggcatgacagcaactgtattggtttactagagttgctgtaaaccacactctgggtggcttatacaacagaaatttgttctctcacggttctggaggctgcaagtttgagatcaaggtgttagccaggttggtttcttctgagggctgtgagaaggagcctgttccatgcctgttccctagctgctggtggtttgctggcaatctttggaagaagcatcaccctgatctcttgcctttattatcacgtgacattcttcctgtaagcctccctctgttcccaaatgtcccccttatgaggacactagtcatgttggattaagacctaacttaatgacctcattttaactaattgtattagtaacaactctaattccaggtgaaattacattctaagatactgcaggttgaacttcaaaatataaattttggggggatataattcaacctataatcgcaacctataaatttgtcaacaagttctaagataaattggcaaaaaacataatagatctacggtagataacacaaaggaaaaccatggacatttagaacactgctaagaactatgataaccagtatctgtacaaatgtaattggctctggtgttgaagaatcaattatacaaatgtatgtaatgcacaagtatattttatcataacctctgagaataaaatgaaataccatatgtgacagcactttacaagctgtgtggtattcaaattaaggcattagttttattgctattaccatgtctttatttatataggtagcttatttttattgttacattgggcatttcacatttttatggtccatttctttttatttcagttacatcctagattaatatcatctatgtctatttcttcttaggaaactgagtttctccattcctttttttccttgatcattagaaaacatctttcccaactcccatttaaatgcaaaatggagtcctggcactgggttgctcaaatagccaactccatctaaacttagctcacgacagaaggaacttaaactgtcagcaaaatcagcacactgactgcaaaccagttctcatagagatcaattataaattgagacggtgttctggatgctttagtcagatttggctggtaccccaatgatctctgactctatttcttcagatactagtatgaattttcatcttcaattataacctgctaccaggatggcatatacctgatcctcttctatttattatttattttgcagaaaataaaaataggaaaaaaaccctatgtttgtacttttacatttaactcaaaactcaaatattagtgaattcctttgatttatgtgaaaattaaagttggatctaacataggcatccagcctcctttttttgacctttcgtcatactctctttgctactctcaaatttggtcaccccacactggagactggtaatttgcaagttaattcattcatccagaatttattgagcacccatcatttatcttgtactcagctagcagctatagaggagataaggctagttgtaagtatgggatttggtgaatttaatgttattgttttgattaatgactgggcccactggtttccgatatgcagtactttgcaattttgaggggcactgacttgacatatgcgctgggctttgagtgggagccctttataagtgagggagtggagtgaactgctcagcgcccacagctcagtggcttgattgttttccacttgccacagccttggctctcctcaatttttaattttctgaattttatagggggaaataatgtactgtaatggtaatcatggaaagccttaaagtgtgtctccaaaaatactgaaactctcttctcctgtataaaataaaaaaggtttgcaatctagattcagagtttagaaataagtaccttgacattttcagcccctaagagaaccttttaccccctaaactttctgtagaatttataacctataaccaacaaaacaccaagttatttctcaagcagctatgcagaagctcttctatttggaaagggaattaacaaaatcagtataagacttgggagctttctgcaaggagtttataaatctcgtcggagagaagggacaggtttctttttatagcatcaacacaagtcaggaaagcaggaaatgataagccatgttatttgttccggagtctttaaacccagactctacatctaatcaccatcataaaaatgccttttttttacctccagctttatagagaggagcctcagagtgggccatcctggaggagtgcacctatcagttgagaaatagggatgacaaggatgtaggcagctgttgcattctaaaatgtgaatttgttttgtgaaagcctttcattaacaaaattatgtgccgagaaagggcaatgacaaaactgaccaaattccttcccttgtaggtcagataacatttaagagctttacatgtctaacaaacttgaggttgctcaaactggacaaaggaggagattaaaacactttctgtgatgacataaagcagtgctacgggtaaggcctcagtctcctgccagcagaagcaaatgtattttctccatttaaaagagttgccttcttaacccacacttccccaggcattcggtcctgatagggcttggtttgactgattaattgtaattctgctccatacaaggtagacagtgatgaattgatacattaaagatgtgattaatggttactttctattcagtgtaattatcaggtgatagtttcaatgaaaaatgctggaaaatgaaacttttcactctagataactatccaccctgtctggaaagaaaaatggttctctattttcaacattttactctagatcaaggccaagagagacagagagacacagcacactggctttgtgagttttatagaatgagacggatttggaataatgcctgtctttaaagaaattcttagagaggaaatctctggataataaaactttaaattttatcttaatcctggattactttgccagctcctgcctggtctttctggtcaattctggcatttaatctatcctgaagatggttttggattaatttccctaaagcaccgcattaatcatatcacatctgttttttttttttttttcggagacctccaacaacttcccacttaaattataggaagaacaaaacatcaacatgaccctcaagaccctttgataaaaggcaaacactctttgtcaaactgtttcaattcctgtgcgctgttctttcgaggctgtcagctcactgccatctcagctggccatgatcccccgaggccatgctttgctttgcctctttttctacatgtttttagctggtagaaaaaattgtggacgacttaaaaagggaccaaaagattaccaggtttccttaatggagaaattttgtgctgtttagaatgcatcctctgattcatctgattctgtagggttttggcatttcattgttttggaactattatataattttgtggagttagaagttaacttgcagaaaattcatagaaatataaaacatcattttctttttttcttctctttttttttttttttttttttttttttgagacagtctctctctgtcgcccaggctggatggagtgcagtggcgcatcttggctcactgcaagctccacctcctgggttcacgccattctcctgcctcagcctcccgagtagctgggactacaggtgcccaccaccacgcctggctaactttttgtatttttagtagagatggagtgtcaccgtgttagccaggatggtctcgacctcctgacctggtgatcagcccacctcggcctcccaaagtgctgagattacaggcatgagccaccacgcccagccaaaatataaaacattattttctatatacatgcagataggttctgtccaatggagattcaatggacttttctaacctgctgtggaagaagccaggtttttctgtgttaagcaaattcatgttggcatttttgttggccttttatagttactctttgggatctcctttgaacttaggacatgttaattcccatcttcctaactaatgagctaaataaaatctttgacatgtacattttatatctgtgtaaactcatactcatgatttacttattttaaaaatgatcctttaatataatctacccaatttaaaacttagacaagtttttagagcagttttaggtttacagaaaaactgaatggggcacacagggagtatgcatatatctgccacatcctttcccagttttccttgttaacaacatactgtaccacaccagagaggtacacttattccaattgatgaacctgtattgacacatcattatcgtccaaactacatagtgtacttcaggtttcactcttggtattgtacattctatgggtttggataaatatatagtgacatgtatccacccttctgtctcctacagaatagtttcactgtcttaaaaatcctctgcactctgcctatttatccctccttaccctcaacccctgacaaccactgatctttttatgtctccatagttttgccttttccagaatgtcatatagttggaatcatatgattggcttctttcacttagaaatatgcatttcagtttcctccatgtcctttcatgtattgatagctcatttctttacagtgctgaataatattccattgtctaggtgcgccataatttattctttcacctactgaaggatatgttggttgcttccaagtttgggaaattatgaataaagctgctataaatatcagtgtgcaggtttttgaacagatatatgttttgaactcattttgtaaatgccaaggaactggatggctgaatcatatggtaagagtatgtttaattttataagaaactgtcaaactgtctttcaaagtggctgtgccattctgtattaccatcaccaatggacaataactcctgttgttcaacatcttcaccagaatttggtgttgtcagtgatctggattttggccattctagtgcgtatgtagtagtatctcattttgcttttatttgtatttcgttgatgacgtatgatgtagagcctgttttcatatgcttatttgccatctggatgtctcctttgatgaagtgtctattcagatctcatgcctatttttttaatcaggttgttcattttcttactggtggactttgatatctaaccaattaaaaatttgaactcaacttggctgtacattagaatcatctatagagctttcaaataatacaggtttgacttgtgtacgtccttattactccagtaagtcacatatcactggagggatggtgatggcatacatagctaagtcccatgcagagaacttctgatttgttggggcctgggaatctgcatttctaacaagttcccaggtaacaggaagcactttgagaacacttgctctgcttagtatggattactagtagtacagtttgttaggctctcttctttctctatattagcctgttttaaatttaattgtatgtcccatattttgtttacaattagctatctaagtatatgtgcttttgtaatcatagcttggaattgcgttttctaggttagttttcaaaataatgcttatattctgctaagtccctgccttgtatttttgttaacagactgacagaaattggtgcctggcctatggcctagtggtcttcagaaatgttcttccaaaagctttttaactaagaagacaaaacaccatttctactcaacttagctattatccttttaaataaaactttttgtaaaaatatcccaacacaaacaataagattaaacaaaggatcatagatttctccctaggattatactctctattaagcacagaattgaatatatgtataatcagattttaaaatgagtttgggtctgcctaacctaaaatgtagatgagtctgcctctttctaaaattttaaatcatagtttcttgcagagaaatctggggatgtttaactgaaactttgactttttaaatttgaattttctgaggttgcagttgataatatttaaggtgaatttatttggctataactgaatctttgcactaaaagagagaaatacctgctattttaaataaatccaaaacaacatatctgcaaagctgaataaagtctattttctctcatataagataacgtatttcaaagatgatgagatacggagtaacctcttgatagcatttggttccctcctcattgatgttccactgttatgaatccttgcttaatataatgctcattctccttctaggcttttcttttatctcactataaaatatttttgaagcaaaagtccttctggagtgaacacacacatgtatgttaagactttaaggtatttacctgttaagaaatatttttttaaaaaagaacaaacagaaagcaaaaagagaatcacgaaagattcaaatgaatatttcttattcatttcgaaaagcatgaaatttctatcttagcattcatagatagtattctgagcatgcattttacccttttgcgtgttactttaattttgctttgagacaaaagctgaaaaagaagtatagtatatgtgtgcatgtatgtgtagtttcttctctttttgtagttagtgaaaagaatttacagataatggtatatcagttaaaaccaagcttaaatgtagtgatcactgaggggcaaatttctgctttgcttagagttgttaacaacctcaggtcacctgttacatacctttatttatttgtttatttatttattattattatactttaagttttagggtacatgtgcacaatgtgcaggttagttacatatgtatacatgtgccatgttggtgtgctgcacccattaactcgtcatttagcattaggtatatctcctaatgctatccctcccccctccccccaccccacaacaggccccagagtgtgatgttccccttcctgtgtccatgtgttctcatttttcatttcccacctatgagtgagaacctgcagtgtttggttatttgcctttttttaaattgagaaatcaattatgaatatttacaacactaggcagccaatgactcagataaactgcatttgaacttgtcgtggcctgacaaatgcaggctttagactttattgttagatattaagaatggttcacttttatgagtgaaaaatgtgaaccatcaggaaaccagaaatagtctaggctagaaccttagcaccaccatgaagacttgaacattatgtgaaggggaaagtttggatctcaaagtggattgagctagaagcccatcaggatccaggttcagcatctgggctgtgaagaaaaattatcagacttagaacattaactgagaaagcttgtgttagctttttatttttgcataacaaattaccacacacttaactttaaaacaatgagcgtttattagttcatagtgccgcaggttagaattttatcactgcatagctgggttctctcttcagcgtatcatgaggctggaatgagaatatcatatgacctacactctcctttggagactctagggaagagaccgcttccaagctctttcagattgttgacaaaatctagtttcttgtggttgtaggactgaggttgccagttccttactgactctcagcttctagagactgcctgcattctatgccatgtgcctccagcgcatttccctctcgttgactctctcattcttctactcgctttgattgacttatctgtgattgccagattcagacttgaagggctcatgtgattagtccagctccacccagatagtctctcatttttaaggtcaactgacttggacttttaatatcatttgcaaatccctttccagcgacacctagataagtttaattgaatagttgggagtaggcagtacatcaggggccagggactctggagccatctttgaattctgcctatcactgagctacaagttcaaactcaactgggcagcaagctgtcgagctggcagacacccagatcaaggaagcattgctgcagagtggacatccgatggacagtggaatcttcaatatttcaacagctacacagtgtcccattagaaatgatggtggcgattaccaccagaattggattttctctcaacttgatgtccctagaaggtctgaatatttttggacggagtatgacaccaacatgtgggagcaatttcaggttggtaaagcctcaagaagggatagagagtttcctgacaaaaggacacatagaaaattgagaatgatgtgactttgtattacaaatacacagaggaattcataacatataaacattgttttatggcccagtatgatggctcacacctgtaatcccagccctttgggaagctgaggtgagcagattgcttgggctcaggagttcgagacgagcctgggcaatgtggtgaaactccatctctataataaatacaaaattaattagctgggtatcatggtgagcacctgtagtcccagctacttagtaggctgagatggaggatcacttgagcctggggaggtcgaggctccagtgagctgggatcacaccactgcattccagcctgggtaacagagaaagaccctgtctcaaaaacaagcaagcaagcgaacaacaacaacaaaatacccacattgttttattaacttgctataagctcttgccccacatcaacccttgatatttgccatataatatgggagacatatgattaacagcagagtggggttcagcatccctgcgtcacgtcttactcactgcatgatgtgggcaaattaatcctaaaccttagttttcttttctataaattgggaaataaactagtaccagcacataaattatgaatagtaaataaaatacaacatgtaaaaggcttacagcagactttagttaagtacttgataaatagtcactatgttgagattaagttgtctggttcctaaagttaccaagccattgctatggtttgtatacggtttgtttggccccactgagtctcaggttgaaactggattcccagtgttggaggtggggcctggtgagaggtgtttgggtcatgggatggatccttcatgaatggcttggagttctcttcaaggtaatcagtgagttcttgctctcttagttcccatgagagttcccaaagaactgattgttaaaaagagcttggcatctgccccatctctctttcttctctcttgccatgtgatctccacgtactggctcccctttgccttccaccatgagcagaaggagactgaagccttctccagaagcagatgctggtaaccatgcttcttgtatggcctgcaaaaccataagtcaaacctcttttctttataaattatacagcctaggccgggtgcagtggcttatgcctgtaatcccagcactttgggaggccgaggcgggcagatcacgaggtcaggagttcgagcccagcctagccaacatggagaaaccccatctctactaaaaatacaaaaaaaaaattagccgggcatggtggcgcgtgcctgtaatcccagctacttgggaggctgaggcaggaaaatcgcttgaacccaggaggcggaggttgcagtgggccaagatcgcgccattgcactccagcctgggcaataggagtgaaactccatctcaaaaaaaaaaaaaaaaaaaatacacacacacgcatgcacacacacacagacacacacagcctcagttattcctttatagcaacacaaaatggactaaggtagccatgtaggtctttgatcatttttaaactgattttttttttcatagaataggatctacgttgagtcattcatttactgtccatttgttcattcagttatctaagtcatatttatcaagctgcagacaaagcaactgagatgccaatttaaatgagaaacaaatccctggagcttgtggtgcttacagcctagagattctaaaggggatcattcgcactctcactccacttcattctcactgagattccaagaaaaacttaaagggaacataatggcagttttaaaatagagcaataaagcaattttctcacattccctcaaacactgtaaactcttgcaatttagagacataattttacacatttttgattctacctaaagttagcatggtgggagcacatagtacattgatttaaactaaaaatactagaaacaggtattgtctttaggagaatgagcaataatatttgtgaggaccagtgtctaacgattaggcatcatcttaaacaagaaacatattgatttattacatgaaggttacaggcctaacacaaaagtcaaaatgaagcaacatttactgcaatctatgcttttaagtaatgcctctcaacaaggtcccaggtgttttagaagctgcgctattttagcacaaaataatatactgctgacttttcctcattgcttttgaaacaatatggatctacttttgtctcatttacagaacaaataaaaaagccctagattcagtgagtcagtaaataagacccatttttaagagaaagctgagatcctcagaaaataattggagagaatgacaggggtttatatacaaaggcgtaactcatgacatcattagtatttgtagaaaattacaacttaactacatcactagcaaaaaagaagtggttaagtaaattaccaaatagtcacaaaagtgccatattaggcaacatttacgaatgttcatgaagaaattttattggcataaggagaggcttagggcaacgttaaatgaaaataaaagcagactttggtcctatagcattgcaggatgactatagttaacaataatgtattatataatttcaaatagctagaaagaagatattgaatattcccaacacaaataaatgataaatatttgaggtggtgagtatgctacttaccctgatctggtcactatatgttatatgtatgacatcactatgtataccataaatatgtacaatgtcatttaaaaaatttaaaaagagttgaaaatacacataatatttgcaattatcataatcatatttaatttttttcctatataaaggggctactggttattccatttcagccgaacatcactttagaaaaacagttggtgcagtggttgagtgcaaattgaaggatgtagtaaaggtctccataaccatctggctgagaacagaaatgatttagttacggatttttgttgtatgttactgattggcactcagcatccaaccccatctctttcagttgcgttctatagaagtaggaaacctaaaactcatgtatctgattctctctggaaactatggcactagatgttagattctacaagttagatatacaattatgctgtccggtagaaaggcaaaggtttttttgggggggggggtaggggacgtactgtttataaaaactggaaataaacaagattttattgtagcaccttactagtgagcatcctgtacattttgtgagtgttgaaggcaggggaagtttcttgaaccgggcattccacctcagtctaaaaccaagtgatggcttgaagcaaaggaaaaagcccctcaagtaggtcagttttataaagttctgggagtaattcctggaggcccagcctgtggagtgttcctcctgtaccccagtgaggctgtaggcacttgctgctcggtgttaacccccttcctgctgaaaatatcacgtggtttctcttttctatcctaaaccaaatgaagacaaacagatataacgtgaattctgctattacagggaatattgtacacctttctgtaatgtcattgattatgtttttgtcatgcatgtgttttgagctccttttccataaaaaagtgctcatggtaagcatatacaagaatacacattagtggatacgaggagtgagtagaaagcatgcttgagggtggttataagtgtgtctgctacagactctaaaaaccatttcaaatattttcttaagtcagcactaactatacataccaagataatacattgaataattatcttctggttaccaaatttttcattcaaaaattaataaaggagaaataggtatatattctggaacattattaccttaaccagatactgtctctttctcttttcccaaaactatgtattgttctctagttaccctggccaagatgagaaaaactccaacctcttggtggttgcagaggccctccatgcctaaatattaatagttggaaatacagtctttgtttttactcaagccagcaagcatttatcaagtatatctactggggataaaatagatgctggagatctaatgatgattcagatatgaccctaattctttaaaaaaaactttcactatcttgtgaaagacacataccatgtagtagtgtactggtaaatgtttatcaaccagttttctaagaaaaaaatgtatgtgcatatatatgtgcatatgtttattataaatattattataaataattgcagcacaatttacaaacacaaataaaaatagaatcctccttattgtaagttttatataatgaattgctcctcaaagtatgctttcatcaattttactgaaatcttatatctgtagccaactgatggttgcaattgaggaatgagtgtagtctaaaaatgaatgatagtttatgtttttgtgtatgttaacactatgctaacaagtaagatgaaagggaagcaattaatatgaatcagatcttcactcattcatcaatgacatgagcaattgcttttcttaattgggtaataatttctaaatactgcaaagcattttctggattttttgtgttattcacaatgtaacagctaaaggcacaatacatgttaagtttaatgtgaagtgttaacattttctcaatcactttcttaagtctatactaacaatataacagtaatcaagttctgctttgtaatgtttgtcagtttcaatggtataaatactcccatcatgaacaattgcaagctgctaatggaatgatactgaataaggagttggaaagagaggcatagtacagtacctcattattttagtattcccaccacacaaataaaatagaaacaagtaacttcaaaggcatatataatagtaaaatgtaataagctaattagggagtaaggagttttgagcatttattaaatttatctttaatacaatttaactgtaatttcatagagtttacttttaaataatggctgtatttaacaattagcttttgaaattcactaaaatgtaaggagtggctcttgtgagcctataagggccatctctagcacaacactggatatgtgattggtgataaaggtggaatgaagcatgaggaaaaaatagtcgtctgtatttggggaaaatcaggaaataaatcctgaataggagccagccaggcaacactgggaggtgtagtgaggggacatcccatgcagagcagggagaagggttagtggcagaaggtatcacagcccacttaaaaccttccctcatctcttagcattcgaatggggtaaggtctgcagaagccagattgacaatgaaccttctaggtcaaactgaggtgtgagactttcatcttgtttgagactgacagcctttcagaagttttaaaagcaagataatgcatttgcattttgaagcaatgactctagcagtagtatggagcacagacagtagtaaagcaaagtcatgggtgggaaggccagactggtccatcaacgctgatgttggtcctcttatttgtctttggtcagcatctttgtgctttctctttactgtctttttctaatttgatcctcccattagcaaaggtcaaatcccaaataagtgagagtttttccacccagccatccagatttagaaggctcagaatgtacccaacctcttcctattttttttttttttttttgagatggagtcttgctctgtcacccaggctggagagcagtggtgcaatcttggctcactgcaacctctgccttcctggttcaagtgattctcctgccttagcctcctgagtacctgggattacaggtgtgtgccaacacgtctggctaatttttgtatttttagtagagacagggtttcaccatgttggtcaggctggtctcgaactcctgacctcatgatctgcccaccttggcctcccaaagtgctacaggggtgagccactgcacctggccaacctcttcctattctatgttgactttatacagctacatccaaagtgaagttgttaaccaaaacatcattacagttacaaatttaggaagaaaaatcaaataatatttgatgttattaggaaaagtgatactagagacttgaaacatactaccctcaatgacaatagtgatgcatgcagacagtgttgagaaacttagagagtcgatggaaaatttagtttattttaatttaggctgtatgtagctcaaacatatgctgagcttttataattaaatggagtttctttcgaaagtgtgacagctctttgctttctttctacaagattgaaattagagttggaggacttgtgacttctgaggacagagaagaatgtaagcagcagaaagtttctgggaaactttctagattatgatttgaggcgattatttcactgcctataccccagacacctgctacttcctgtttgatggtaaacttttcccttcagtttttataaagagatatggcatctgggacaattgcttggtcacatgaatttatttgagggaggtcagcatttctagacaactttgatatttaggtgatggaatgaaagtcaaaaaaaccagcattgagattttaatttgaaaatactgagttaagtctttagtgttaatagagctatgtttcccagttttgggatttcatgaggaatatgcttgtagagctgaggaatgatgcaggcattatgaacagaattgaaacaaaccatataaaaaaagctctcatcaaaagaaaggaaaatagcaacaaaacaaaataaataactcttccccctgaaaaaaaaaccctcaaaacgcttgaaaacatgttcatgctgaaaaataatcaaatacattgaaattaaaacaacaatgagatattcttatatatattctaatgagtatatcaaattgaaggttcacaaaaatatatactctcatctactacttttatggtgaacacttttaccatataccttaaatgtttatgtgtcttgaaggtacaccagtctctagaattcatgttcataactggtatataatactgcctctttctgtaaaccgctatgtgttgttggtctttttgtgattggtttatttagaatttcatttgtgttctacaacctatattagatcttaatctcttccagataatacaaaacaaaacaaaaaaatgctttttctctcatgtttcttttagtaatgagacttttatcaacagttaaacatttattcaccccaacttcattccccaaaccactggaggcagcctaccgcaaaatcaaataagtttaaaaggacagtaaaaggacgaaagtttaggaacaagaaaaaaatgaatcataagaagaaggctgcagcatgagaagaaaattagaacggtaatatagaaactgtaaggaactctaccaatggaacagcagagccacgcaattaatagactgggcttggaagtcaaagggaaggagccttgaccagctccactgcttttattcactgagtgctaagagcagctttgcataggatgctccacgaagagctgtgaaataagatgtagacctgaggactgccatagggtcccttgaggtaaatgcactaacgcgtgtctctgaagctgatttcctcactttagaacttctaaatccccgcaaatctccctccaaatttcattctgtctctactttctaatattcatcgcagtcggtcttttaaaaatattttttaaattttattttatttttaattgacaaataataattgtatctatttatggggatacaatgtgatgttgtgatagatgtagggttcacatccattgtcttttgctgtagcctagcaaacgggtctagctttccagcaccagagccagaggaagccttgctttgtgtgggggattggcggggagaagtgaagaaagcaatggggatgcatttggtctcctctccaagctcccttccttccttactttatagcatgcccacttgcaacaagaatcagcctaggacacccaaagtgcctttgcctcactgctgtttgctgcggttgtgatctttctcactggagttgtgaaaaagcagaaagtgagtcctcaatgtgtcaggcctgctgagctactgtgatggttaatactgagtgtcaacttgattggattgaaggatacaaagtattgatcctgggtgtgtctatgagggcgttgtcaaaggagattaacatttgagtcagtgggctgggaaaggcagacccacccttaactgggtgggcaccatctaatcagctgccaaggaatataaagcaggcagaaaaatgtgaaaaggggagactgttctagcctcccagcatacatctttctcctgtgctagagaattcctgccctagaacatcagactccaagtttttcagttttgagactcggactggctctccttgctccttaagcttgcagacagcctattgtgggatcttgtgatcatgtaagttaatacttaataaactcccttttacatatatatatatatgtgtatatataaactcccttttacatatatgtgaatacatatatgtaaaagggagcttatatgtgaacacatacatatgtaaaagggagtttattatatattatatatacatatatattatatatacacacacatatatgtgtaaaaggaagtatatattatatatacatatattatgtatacatatatacatatatatctcatatatatacatatatatctcatatatatttatatgcacatatatatatcctcttggggagaggtcaaaagaagcaggggatacaaatctgactgcaaaaagattgaaggacagtctttattgaaagcctttggtggggatacagaggagtgaattatattgagagataactcagctgaattttctataaattcattgttgctatcttccattttcctaaccacctgctgacttaacctgggttctttctccatttgctctctgactctgcttacctttcctgtctctgtggtgcttctcggtctttctctcatgttccttccattagtctgtctgactgtctctctctgtctcccccagcccccactggatcttcctgcatgttctctccttccagattattctctcttggtgtttgttctatgctttcttgtaaaaaaacatgttggcctctctgggcttttgtaattaatacatctggtcataggggaaaagaatgcttctaaatgttatttgtttttccctgacatgtatcaaattttagttttcactctacctaaagtcccgtctccagtttgaattcaccactcttgctggtggttagataagcaagcaacagacaacgtacacacagaccacatattgagaaacaagggagcctatttgaaattgcagaaattaaaacaacaacaaaaaaaagatgcataaggagctttctgaggagtacatcgcctacccaccaccccacttcaactggaaatctgtttccagtcagcagaaaactgaccaaagacccatcatcaattatactttgtgaggatggttgtctctgaaatatgcagagtggcccagaaattgtagaaaagaagggtttggaaggtccatgcctataaagccaacaagacactttctgcacctcaagaaaagtagtctcgctgttattgtattctgtctgatcaattttccttattttaatgacacatagttttcatgttttgtaatatttttgtcatcacacatggtaaaaagccaacccatatagtctgaggtggaggatgggaaagcataagacattcatacagtgacccttcaaacagtcacagatgacatggttcctggacagtggggcatatctcccagatgaatttcaatgaaagcaattctatagagagcagagaccattgtggcctaaacaaagagcttttcagtgacccaggaagagccaagtatactacttcaggcacctggagcaatggatgacctgaatgtcctcaacacaatcctggatcattatctttactttcaaccagattttgataagaggagatgtagtcagtgatttgtaatcccacagtggtttgccaatggttgctattagcaggaaatcaattcagagatgtcatttgaggatgaagctcctcggtattttgatgcctttttaggaagctaagaggagctccactaccagctcttcagaaaaaatctcctgagttgcctaatttcacctgaatttttggagcacacatttaaaaattacttgtgaatcaaattcaatttgaaaatatgcaacttttttagctcttgctttctccctgagctatttcttgaaaattgtggaggaattgcttctgctcattgggcccatttacatgaattatttatttttatatgtattacatatttgtctctcctccctcctacaagctgttccatagcaagacctctcgtccctatatatattcatggtgacattacagccatcttcaccctctgatgtctaaaggaaatggaaattctgagggtcttcgaaaagcaaaaagccaggtttcctttattctagatttctagaggatttcatagccactaaatctgtaataaccagaagtaacatacatgcatgtacctgggaagttcagtgataagataaatgcatagatgtctttacccatgagtatataatgcatcattttaactatatttttccatttttcggtgttcactttgtagtcatacaaatactagccattgctcattgagtactgtatgtcaggaactatgctatgcatttgtgtaaatcatcacatctctttccagttatcctgcatagtattgttactccatttttttttcctaatgataaaactgaggcagagagaagtaaagtaactttcccaaagttacaaaatcagtaagtcatgatttggtacaaatatgccaaactaccaatctgggccttttaactccactctgctgttgttacattatccttctcttgcacatttaagccatattatttcaatgaaattctgcaaatacttattgagcacttgttatatgtagccattgtcctagttactggggtcacagaatgaaaaagtggagccaaattataaggaggttagattctagtagacaagtcagaaagatgaacagatgaatgtcctacagggcagtacaggtataataagtgtttaccacttaactaaaggtggctcagatcagagaaagacttagtacattatggtgcttcaggatgctcactggtggccaggcagaaaagagtaaagacaatggcattccagcaaaagagagaggcatgggcagtgtcacctactggtgaaataatgcagacaaaaaaccaagaagagtaatttggtactgttgggccataacagatacataggggaatggtgggaataaggatagaaagtgactggggacagacaataaacataattcagtcttacaagtttggatttttccatgtaagttacaaagacccattcaaggaattttaagcagagaaataatcagaacaagtcatgctcagagtaaatataggacatcaaattgtttatcaagaaaaacagtgttttttattatactttgtgttttactggcaatgacatattcagtagatctctttttatctcagttgatattagacattagaaatgaaggctgcggctatattttaaaatggtaaagatcttccatctgtctagataaaattttgttcaacgtttcagtcacttaggtgatggaaatttggctctcctccatgaatcccactttccttgactccttcctactacaatgtcaattctcctgccctttcaaggtagagaaaagtgtttgtagtctcaaagataccagatggtatctttgcctccttttgaaattcatggcacttatgttattccacttttccactcaatgtctttgtcacttgcctatatcctagttgctaccagtgtcacagaaaactctgaaacttgatccttgattctcctttccatttcaactcccaccatcatttttgaccacaccaatatctttgtatgcagtacaataatctgggagtttgtagaaggaaaatggtacttttgactttggggattaagagaagttttaagggagacatgttctgttgctctgctcttccaaaggtaaatgaaactggaattattaaaaattgggagcagaggccacatttcctagttggaagaaacagcacaagcaatggcataatatgaaaagggtggcaggaaagcacataatcctgtgtgattgcatcatagaggatataaaaaggggcaatatgatacagggctaaagtggctaacttgttctacattttagagaaacttgttttaatatcaagagaaggagactgaatttcatttggctggcagtggtggcagggaggtggagatttttgagaaatgtaatgatcaaactgtgccttaagaaggtgaatgaataattttttaggttgggaaagaggatggagagagggagaagatagagtgcaaactgctgctaactattttgcttgttgtccaaagtgtgtctaagatcatctaggcagaggtagcaggaagtagaaggagcacagtgtctataactgcgtttcaaagaatgccaacacttaataactgaataagcttgggttggtattcaagtgaacttgaggaggagtgcctgacaggaaggagggaaaccagggaaatacttggcagtggcaagtagagagaatatgctctaggtcagaagcaccaatagtgttaaaatgaaaacaagaggtcaaataagatgtgaactggacagtaaatattagttataataacatggagatcattgatggtcttagctggttattagatcatttgttagcttcattgggggcagaatctgggagaatttggtagaaggaagtgctgcaaagtgggagactcttgagggaaatttttaaataaacactgttggtataattaggaggggcagatatacattcaaatcctgcttctcaattaattttatgtgtggcctgacttctcgaaatcttagtttcctcccggtggataagagaatggaagccaatgggtcattatgtagaataaatgagatcataagtcaataattggatgaaaagagttctgcgtttgcttgacctaagtattcaataatggtggcaattactatattatttgaatctggacaattgttacatattggaggaggaggttacaggtgtatacataacttgttagttatgttttgactgagaataaaactgttatcaagaaaaacgaggaagtcaaaaagataatctaaagaagagaatgaagtaggtttgtaattttttcccttttaaaaatatgcatgcaatgaaatgtgcagatattttacatttctgtgggttttgacaaaagcttatacacatttaattcacaacctttgaggctatattctatttctattactttaaaaagtgccttcattttcctttgcaggtcactcattctaccaccacctgtgggggcaactactgtttatttctataaccatagattagttttttctactctaggttttttggagtgatatagtacatacttgtttgtttctggcttgtttgaatatactactttttaaatttatccctgtggtttggggcactgatcgtttgccctttttttcattgctgggtttaaatatactaagtataccatattttttttgtttgttttaaaatctatccacttgtttatggacatttttgttgtttctagttttgcgctattttgaataaaatttctgtgaacgtacaccttgtataagtttcactgtataagaaatcatcacatgcccaagccatgtagatagttccttatgtattattttgttttcccaataaactttatagtcagcttttatgtttagagcgggtattcatatagatttaattattgtttgtggctagaattcagtgtagttcatgatttttttctatattaatattaacatgtttcagtgtaatatttgaagtatttttctttctccattgaattgcttcaaatatttttataaatttgtcttttgtttttagaaatatgactattatgtatctagggtctatttttttaatgtgtattctgtttgggattcattgagcttcctctagggatcaatttttttttcccagatcagatttggaaagttttaagccaccatatctttggatatttatttctctgccaatctctttgtcttccttctgagattccagttacacagatgttaaaccacgaagtgacccaggggtcacttagattctgttaatgtttaaaaacttttttccctctctgtactgattttataatttttatttctgtgtattgaagcttactgattgtttcttctgtaatatcccattttctgttaagcccataagataattttacatttcagatattatactttttaattcaagattttccatttggttcatttttatggattccattcatttgatgagaatttctattcgttcactcattataatatccatcctttccaaaatcattgaacatatttataacagctggtttaaagtccttctctattaattcaaatatatgtgatttctctgggcttgtttccaatggcaatttttttctcttggttatgaaagaaatcaaggtactttattatcattggaaccatgatataaatattgctgtgatttgacttgacacagctacaagcaattttgatatgccttggcatcattaatttattctaatttagtgtttaatgtcccagtaataatatttctagcctaagttggtgtagaatagaaacctcagctcttatgcattggaatagaaaaatacgattacacatgatcatgaaaagcaatgatgcctgaatatttggatttgaactgttttatctcacttaaactgagagtgataggttaaaagagtagtgctgcattgagtaaaggctattttgacagaatttgttgaacctgtgtttagaagttaagaaagagaggaagaagaaacaggaacactttaaaagagttgatgccaaagacagacacataaacaaaggtgagatgcttttctatttctctcccaacttaccttagaaggctgtgctgtagcaaacgactcacatttcctatgtaaagcctgttagaaactttttcagactattgaatcgccacaaagagagcaaggtgattttgtataacatcttattcagtatttactagatagctgatacatgcttggcactctaatgacgttgtaatgggtgggcacatccatggttcttcatcgagtttagagactggttagtgtattattttatgctgttaattttacaattgtgtaggtgccaccaagtcctctaatgaacaacctttgctttctgattctagaccaaagatcttctcacatatatctatttcttacatctatttcttattccataatctctcaatctcatgttctttctgtaaggaatgagaatggagatagagttatatagagatcatagaatcttggatgtggctttacagttgtgtttttttcttctgttttaaagggattggggagggaggtcttataagtatatggtgtttcacagatacaacactctgggattccatttcaagttttaatgatagtataagcagtacattgaaagacagccaataacattcatctcttgaaataagtatgctgcagggctgaaataactttggctttattgctttgaaacttcgtgaagcttgggttaagctcttggctatgttacatctgagaaatacagacctcgtttcacctgttccacactacagctgcagttttatttggaaaattgatgagggcattaagttctgaagtcatgttgattctaatgtaaataaatggtgtcattacttcatagttgggagtgccactaatgcagaccttaaaattaagggttatcttgttgattgggggaaaattaaagtaatcaactttcaaggctttaataaatgagattgcacacttaaaaatcattttcaaaccagctttaaaagtagatgactagaaaatcaatagcaataatacatacctatggaaacagaatgggctatatttatttttaaggatagtttcttgtgttatttggtttgaatttattaataaggggcttaaaagtaatcatataaaatattaagtatattttcataggaaaataccaatggtattttttgtggcagttaatacacatagagccatgaaagttgaattttccaaaagaaaaaaatgatggtacaggttcagtacacctaatgtaaattcatgaaatcaaagtatataaaggtttttctaggaagttagaggtagagagggctcaattctattcctgtatgtaatacttgttaatgtgtgtgtgtgtgtgtgtgcatgtgtgaatttgtgtgtagcatttattacattataaaatatagtatataaccttagaaactaagctctttccaatattggaatataaattgctttaaatatttggacacaatcactaccatcactattattatcatcatcatcccagctcatatttatgtagtctgagtctgggccagagagattccatgctaagtcctatttagtatgaagtgggctctcaacctatatctgtgaattaatctttgtgtcaccacaagtgtccagtaggctgatctgaacaaaatcagtactcaggatatgctttgaactgttaacaccagaaggcaagggcaactttcacttttacacacataagggagagtgtattcttcaatttcatgagtagagagtggtgtacgtgagaataatttataaagtgatgtcataagtccctatgtgcctgggaaacacaaacctgcctactccagacaacaactgggtggtttttattattgttgtttgcttttacgtttgaagcagacttgtgtggcacttcagaaacaatatgagatatttagcagtgtataaatttgagtttggagttgattcaggtcgaactttcaacagtaatctgatgtatatgtaatgggatacataattagtagtgtgctgtattgtaaacatggcggaaaaaatgtcagaagactacatgctagacagtcctcattgtctgtcttgccatccccagttcctggggccctggactaagcaggcacaatgggtctgagccagaaaagtccccattgtaagtataatcatagtcattgtaataataaaaatgatttccacttgtttcaatttactacatgccagactctatattacatacttaacatgcatatctcattttaataacaacactgagagataaataggttcaattttcatacgaaaaaaatggaggctgaaaacttggaagtgagaatgatatgatataatgaaaataaatgaaatttgacatcagataggcagcattgcaactcatgattcaccatctattatgtgatcatgggaaaattactcaacttgtctgcgttttaggttcttaaaccataacgtcgggattacttttgttctcctattctgaggatgcattcagatatgtatgtaaaactccaaacatagtacctaagacataggagggcatttgcaaatgttggtggtcctgacctcccaccattccttattgactctgcagagttaatgttgacctgggaagttttcaccctggctccagtaaggaaagtgaaaatgactaatgattttctttatccagtaaaggatgtggaggatggggcggtaaacttgggtacttttctacatcctcctcttttcctggcaaagtcccagtaaatacttatgatagctttgtgtaaaaacagcacctgtagccagacatggcaccatggaaggcaggttggtgggcaaatgccctctaagtgtaaaaaagaaggagtgttgtgggtccccagatcacccaccagatttgatgatttgctagaaaggctcacaggactcatcttgtagtcatatatatagctacaatttgttacagcaaaaatatagaaagcagaattaacaaagggaaaggtacatggggcaaagtttggaggaaactgggtgtaagcttcctagagtcatcctccggtggggtcacacaggattgcttaatttcttcagcaaggagttgtgacaacacataaatgccttccaaggagtctaattggagtctcagtgcctagagtttctataaggggctgctcacctaggcaacttctccatgtaccaaattccagacatcctgaagtgttcagcatagaccatatggtttgcataaacaggcaaggcacgaggagccattcttatcagggaatggtgggaactctcttcaaatcccactttccagacctagccaaggaccaactttgcaagcagacctttatatggatagcagtctcaggccttctcagtttatattaactcatattaacatagtcttagggtgggttacctcttacctgcacagaaagacatagttgcgtgccaggacacaagcatagcagagcaggaaacagatggagttttgccctgacccatctgcgtgtacagatacctttaggcaatgaacaatctaccaaaccatggatggcttccctgcctactagagaagcctcacatggaagagcacgctgtgtatgacctcattctgccttcactctctggtcctttaaatgttgattgatcagccttttttcactgacccaatttgccttctctgaagatgctttttgcaaatacagcaggtttgatgaatgcttagcaagaagtttggatgacttctgcactggtttctgtctatttggggctgattggaaaacttaagacactgaatttatcttatacttgaaattctgtaaccactgttatttatgtctctgtgtctgtctctttctttaatctttgttttgtttttcttcagtaagcagttctgtgaggtagttaggactatgattgggtagttgaggctccatgtggttaagtaatcatatcagaagaatttgttggaaagactcagaccagaatacagatttgctgtttcttgaatgagcatctcttctgttgaatcaaattaatactataaaagtaatttcatggaaagaataatcataaagaggcaatatcagtccaaatacagaaaggccttgcttttctgactttctgtagtagtagcaaacccagtggagttctgaagaatgtggtcattgctatggattgatgttagagaccagagctagattagtcagactggtcaactcttctagagtgactggaaacttaagcatctaagaacaagggcaaatcagtacaaatacagttaacccttgaacaatgcaggtgtgaactgcatgggtccacctatacgtggattttcttctgtttctaccatccctgaaatagcaagagcaacccctcctcttcctcctcctcttcagcctacctgacatgaagatgacaagaatgaaaaccttcatgttgttccactttcacttaacaaatagtaaatatgttttacttccttatgattttcttaataacacatttctttagcttgttttattgtaagaatatagtatgtaatacatataacgcacaaatatatgtcaatagactgtttatgttattgataagctttccagtcagggataggctactcgtagttaagtttttggggagtcaaaagttgtactcagattttgaatgcacagggttttagtgcccctaaccccgatattattcaagggataactgtaatcaagacctgacaagtcctgtctagtcatcaaatcaaaagttcatgagtgaggagagatgtaggagaagaacttaaggatgacagaatgaatacattaaggaataaagtagcaagtaaggaacagacttcaaagtaaggatgaaggtccaattgttttgccaagaactgggcttgggtgttcacttttcatctctaagtctgttttattttagcccatattatctccctcttatttggatataagatgtccagtaagtgggtaacttgcctgtttggaagccactacctgttatgaacaaggcttaacttgttcatatttcattcagtatctcccaaatgttgaaataacgatttgggcaggagagttagttttataaagacatcccaccataaaagatatttagtattcaataaagcttgcagttctttaccttaatgttgtgtcttaatatattgactcaggtctcacttgaaatctgaaacatgggttccatgatctatacacttaataagcctttaaataatgaaacaggatatacttgaagggccagctgtctttgtttctattttatgcctgcattttatgggcttgatcactaggactcagactggtccttggcaacattgcaaagttagcgaagatctttccagccctttcctgacttcctgctacatggaaattttttctctgactgcctgatgctctcatgctgcttgtatttcagtgtctgccttatccctaaaggatttgcctgccctagagttgtcttatgtaccagatctaggtttatcaatattctgggagtcatttgttaagttctcaatgtattccttcttatagagaagtctcttattcacagtctcatatattcggaccagtctagagtacaatgagtgggaatgacagtctggaaggggagaagacaaatgcaataccatctggtgcccagaagaacttctgcatacttaatcagaccccaaagccttatatcatcagcaaagtgggaagcttagtatctcacattcacataatttttagaagccatttcataccttataaattttgtcgcatttcagcaagagttcttgatatgtatttaaacctggactctcttatctaagtgctgtcattgggaaggacacaaagtgttactgggtatttgagacttagtgtggttaagcatattgttgaaaagatgggactatactctataaattgtgagaataatcatgacttctctatttccccgcctgggatattcaaggagagagtgctaaaatgaaaagtaccataaaagctctggagtagcactgacaggatgatggagacatcaccatggtgaaggttgtcctgggttgtgagatacccttaatttgataccttcttcctaaaagattaattcttacaaagtttgtctgtctccaaaatacaagggccctaatatggatcaaacaaataacagggttctcactggcttttatagaaaacataaaatgtcacttgagaatgagaagtccagagggaacacagttctccatgctggaaacagaagacagcaagaaagaaagataaagtgtgatctaaagaaggacacactgctcctgtttgtgtggatagatacaactgagggaagagacaatttgtaactggaaggataaggcagatttatgggtgtttatgtgcctatgtgacaaaagggaccttggggtgtaatgggctagatttaagtatgaagtatgactgcctcatgaaaatgttcattcatggaccttaaatcttgcacataatgaggacaagaaactgtagctgattcatgcaaatgtctccttatatatttcttaatattgcccattttcttgttcactggatatgtgagactctggcttcatcatctcatcctagtagtcaacagattccttcacagcatttactgagtccagctctgggaatatgcagaaggctgaggtaggccttctttcagtctgtcctcatagtcatcaaacctgagagggaaacaccttttcttctttgccttgtgttctctgcatcttactgagaagatgttgtaatgttatgcttttgtttgattttgtttcctcatagagactttcagactcccactatgtggtttggacacgaagtcagtctgagtgccaccgcaccaaccccaaactattgtttctggacccagtgtggtcttttctttcaaggaagaatcttgtccatccagtgcaggggttggaggattacagaagttcttattcctttatgtattatgacccccaagcttgtgagctggtcatgagcctcaaggttttcatccactttccatctcattaggctttcagccatccctgcaaatagcaccatcttcctaaagccctggtcattactccgtaactctccaaacacaagtatttactggtcctgactaagagacttggcttataggggatctgagtgagatgttggcccttattcttagtgagttacaatcttctgagcagacaaatacgcaggaaataataagagactaacagaagataaccaggtggtttggatgatcagtgccattcaatctctgctcaaagctgacatacttaccactaacccaccaagtacagatttgttctccaaattcagaaatgaacaaataattaaaaataatggtaagatgatcccagaaaagattagtgtagaaggagaggggtttgaggagacggtggtaacagcaaataatttgcagctcgagaaagatgatcatgatgatttcacattgatcaaattctatttctatcatatttatatgaattatctcatttgatcttcacaaccctaagatataaataattatcttaacacacgaatgtacagtttggaatcattgtaccaaaaagacacatacactcatatgttcatcacagcaccattcataatggcaaagacacggaatcaatgatgcaccgggtaaagcaaatgtggtacatatacaccatggactgctacacagccaaaaaaaaaaacagtgaaatcatgtcctttgctgtgatatgaatgcagttggcgggcattatcctcagcaaattaacacaggaacaggaaaccaaatactacatattctgacatataaatgggagctaaatattgggtagttagggcataaagatggcaaccgtagaaactggggatgactagaaaggggagagaggaaggacggcaagggttgaaaaactaactattgggtactatgctcagtacctgtgtgatgggataatttgtactttaaatcacagcatcacgcaatatactcaggtagcaaacgtgtgcatataccccaagaatctaaaataaaatttgaataaataaataaaaggttaaaaaaaagaatgtagagcttggaaggtttgatgaaccgtcactttcatcgagaatacaactccaggaagtgagagtgaagtttccagaaaacaaagcagaaaagcagcaagagccacaatgagggtatattttggagtggcggagacctattcattgcttgatcaatggaagcatatttctccccaggaatctgtataatctatatctcagaactttctcccaggggtggaaaaagagataaatatccttgacttgtgtctccctaggccaacatttatcccctgggcctgaactgcttccgtgacagtcaattcatttgcagattcccaggagccacaatagtctgtagggaagcctgggatgggaggtgagaagcagggggtggggtggtcccagcggtgcctgtgtgaagtgggtctgaccccacacacagatgggacaagagtcaggaggtgaagccaagaggatttgaaacgaggcaaaagtgatacctagtccattactgttttctttgttttacaagtgaggaaatctcaggcacagaaagccaggtaagttgtctaaagttgaaatctgagatgtgatagggaggacaatgtaaacacagagattccaaactatcgcatccaaactcccaactactaattcctaatggaaagggttcctcttgaaaactttcagagaatgacctactaggtgacatagactaaaccttcaaagagcatcaacaagaattgtaagaaacctgtgagtgagaagcacttactgagttaccagaggacagtgggaactaagagggtgtctttaacctggaaagcaaccagtgaagccaaccacatccttcaatcccacatcctttgatgccctcacctctcacgcacaatagagatctgagctgcaatttggcacccttaaatgtacttggctatgttccagaacagagaaaaggcaatgttcgtatctgtttcacgcttgcctcgtgccagagactgctcagtatttcacgggaacaacacttcaaggaagttaatagcatctccatcttacggatgacgaaactgaggcttagatgggtaaaggatgttctttgcttccccacattgtttttctggtatatatcacaggcgtatgttttgttttgggtctgtatttgccttctagaatgatattcaagaggtggggttataaaccctggctgggcattagaataatttagggatcttgttaaaattacagaaccccaagctctacctgaaacctaaggcattagacctttttaacctaggggaacggatatcctaatgtgaccatatttcactggggatctgatgggaagccagggttgacactcaaaagaatggacagaaaatagtgaacatgttcctgagctgcatgaaagaaatatgcaagattcagaaccagggctgggggaaaagacagtcctgctcttctttgtacaaatcaaatcacctctgaagaggtgctttgagttttgggtagcttactttaagtagcagaattggaaggaagaactgtactggggaataggactgtgtccagggcaccaagacaaagccagacataacccaagaggctgacaatttggggaagtctggtgacggcaactctctcacccacagttaacaaacaaacaagaaatattttctccgggctcagtctctgtagttttggcagcagggagtcagcgtccttcctgaaacatgccctgctgtgttcctgcccagtcttgccagcagctcagtctgcatctgggcttttccccaccctctgttgcctaatccacagcatccttatccctcccctcaggccaccaccaccccccttctcccacgcacccaggctgtgttttagcaggacagctattttctgccattcagcactgagtgatcatcatcaggtacagcttcccaaacacacaactgcgctgcttgtgtagcctcaggtataattacgaaggctgtcccagcactcgctacctacactatacttaatggggagggatggtctcttgttctctattaaatattttgaaagagaacccgtaggcatgacaaggttcaggcaccaagcagaaatgggaatcggagtgcccctgctctgacaggcaagcacaagttttaattatctgctcatccaggatttaaaaattttcgttttactataaaaagcagaaaaggaagacaacatgatttcatgtgcttacaggaaatgaaattggttgagaatattgtctgctgtcacttctctcttatttcttcctttgtagtgtttatttttcctgttctatgaataataaatactgaaaatataaaaattacagaaatgcataaagatgaacaacttatgaccccacagttcagacaaaacttctattaacatttttatatgttttcatccagtctttttcatgcacactcacacatacccacatagagacaaaagaattgattgtattatggtagtttaatattctaattgttttgttttgtgttacattatgagaaaatatttatgccaatggatacatttgaaaaacaacttttctaatagttctatatttcatgtttcactctgatttatttcactttatttccctgttattggatatttaaattatttccaatcctttgttgataactcttaataaattaataaatcacccaagatattaatcaagctcatcctatgtgttgtcactgttcatgtcagcattgtatgaagagtgaatgggctttggtgactgaaatgataggactaaatactgattctaccactagctcagggcatctaggaaagtcattaaaaatttactcatctgtaaaacagagctcatgctaactgctttgcttatttttctaattttgttctctccatttcctaggacaaacaaacaatgtcagataatctctttctacatattcttactcattctgtttctctgaagttgcaactacacatatactcacacaattcctttgttaacactacctcattctcaaggtcaaatccaaattctacatcaacgtctccctccactggttttcttcatctctgacccttctttttccaggccctgcacggatggcatcaaggtactttcattgactctggctcttcacctatgacttcttatgcctttgagtctgccatttctttttcatgggattttctcctgacattcctgcatccctttttatccagctcctcctcatgactgagaaatcatctctagcctcaactcctcttggaaggattccaaatcccaaaccacaggcagggctaagcaaccctccttgctgactcttagggctgaaccatttactcagtaaaagagatgctctattttgaactttctcaatttgaacgtttggtgctttttccctcatttctggcaacatttcaatgtttctttgctttctccttactatatctctagatatttcttcagctatacatggtcagatgactggagttcactagaggtaaggctatcctaaacctcattattctatggtatctattgacagcgtatgaatgagtctgtgaggcttattacctaatattagaaataaaataaatcaccgaaaaacttgaagcaaagtagttagcagttcatagaaaaatcctgagttagattcctggctcagtcttttaccagccatgtggcattgactgagcctccaagatgtatgttctttatctgtttacatgaaaatcatatttgctaattcttaaagttatgtatatagagttatttctaaatgacatataataatcacttaatgataattttatgagaaactattttcagctacctgttatttttacaaaagaatcacattaaaagatgctgttaaaactatgagaatacatgagatataggtggttattagtatttggcattcacacccaaatatctaatcactaaaattattattaataatgaaaatgaggcagatgatcatgacatttatccccaaatctctagcaccttgcacagtttctggtacgtatttagctcccagaaataaacactgaattgaatttatggtaaaataaatttttagaggctttgatattccatttttaagcatccaatctattctatacacactcatattagcatatttatgtgacaatgaaactattgcaaacagagagaagattattaggttatggatattaagttaatggggaagatataaaatatttaatagcttgggctagaccacatcttttagaagaagaaactgaggatgaaaaaatttccgtgaactgccaggacacaaaatttgagaggggcggagttggaattaaaacccaaccttttctcaagccaattagaatggcaattattaaaaagtcaagaaacaacagatgctggtgaagctgtggagaaataggattgcttttacactgttggtgggagtgtaaattagttcaaccattgtggaagacagtgtggtgattcctcaaagatctagaaccagtaataccatgacccagcaatccctttactgggtatatacccaaaggattataaatcattctacgataaagacaagacacatgcacacgtatgtttattgcagcactatttacaatagcaaagacttggaaccaacccaaatgcccatcaatgagagactggataatgaaaatgtggcacatatacaccatggaatactatgcagccataaaaaagaatgagttcacatcctttgcagggacatggatgaagctggaagccattattctcagcaaactaatacaggaacagaaaaccaaacaccacgtgttctcactcataagtgggagtagaacaatgagaacacatggacccaggaaggggaacatcatacaccagggcctgtcgggggttgggggcccaggggagggagggcattaggacaaatacctaatgcatgtggggcttaaaatctagatgatgggttgataggtgcaacaaaccaccatggtacatgtgtacctatgtaaaaaaccggcacattctgcatatgtatcccagaacttaaagtaaaataaaataaaataaacccaagctttgcctccctaacacaatttagctttccttcatacttcaccagactgatttatctactccacatcaccggatttttgcaggtctttcaaaatctcatttatgcatctaggataaacttaaatttaaatttaattttatgttaagcattgatcaaacttgcaaagtccctctaagtattgtgttgctcttgttattgctgttgccctctctccccacctctaatccaaattcctaatgcttggtctttctttttaaacaaagaacttgttttcatagaaatgaatctcttgtggatttttatgttatatgtcaagctcccttatgaatctatccaaaacatccaaagaataaatcccaggacaggaggaacttgtattcacacatctaattaacctttaattgtctattgtgactgctttgcagttcaatagttgcttgatttttattgcccgcctaattagtgtggttaaagtggctttttaagtcagattttattatatcagtttgcttacgcaatttcgggatactccgggaagttccaataacattgtgattcttaagtgctatatatgtatacacatttgttgtttgtttgctttttctcctcaggaaaaaaagtgctttgaccaatttctcccactagagtgtatgagtagtctatgaaattccttaatgatagcaaaagccttttcattaattgtgcataaattatcaacacagccagtcaattctaattaatcatttttctacccaataaaccaccagattgacagatttagaattctgaaacaaggggagcagtgaaggaaaccacccaaaatactgcaatttaaggcaaactaacatatatgcacatctctaaaaatcagattctacagctgtaatttattagtgagtccatggaatgtagctaattgagtatgcatctatcaggggatggttaagatttaaaataatcaattagatgtacaaatcttattgcataccatggatcttttttcttctttttgtttgctgttttattttctaagtaaagaataaacttgcctccaattatataatttgtattttcacatgttagcattcttttcttgttccacaaactttctaaattactgaaaattatcatgaatgcaatttaattttctacatactgagcactatggttgtctctaatattggccacggttgtagtttcccttagactccctgagctcttgctttattttctttgtctctattctcttggctttaaaatagagttaagcagtttgaattatttctagatctctgtctctctctgtattggagagacaaaagatctagtgcttagcagagtcctcaactcatcactaatagtcaaagtattcagtggcaattgccctgtgtatgaaaacagcagtgcaatacagagtaaaagtactggggcatgctgtctcttgcacagaacaggaaccaagagtaatgggttctattccctactctatgtttgatttactggttagccttgggcatacgatgcttcttaccctttcaatgcgttattctttccatctggaaaacaaagataattgtacttgtagggagggaaaagggagaacctgacataaattagtttggatagaaattatttgcaagattcaaaaatgattctgaaatgtaatccattccacatttattgggcatttcctatgttctaacaattgtgctgagtgctaaagaatacagagtttgccattacattggtgctcattatctgataaggtgtagccatataatggtaattataatataatgtgaaaagttaatattgatgagcccaactatctatttctagcagagagaactgaactaaaatttatttgaaacatcttctgtaactgttggctcatcataaatcaaagtgaattgcatttataaggatagtttgtctattagtaatctgaatgaaggaagacagggaaagacatctggaaaattaccacagtagactggattatcgcttgtaactctttcttccccattgtgaaagaattacacatgaattgtctttaccacttgactttgtagcgactcccattacaattgacagagtgtgcatccgtcttccattgactgtggttttggtgtaatgacttgctgtacccagtggaatacgttgggccaatgaggagacattgcaccagttctgagttgagtcttgaagagtcatgggaagtttctgccagcctgatgggatttcctaccatttgccaggacaagatcatgcttcaagtagctttgctccttggcttatgataagaacaaagaaatgctgcacagactgaactccaccaaaagcctggattccagtctaacccagatgataccagtctagaccagctgaccctcagaaacacttaggagaacaacataaatgctgttgctgtaacctttgcagacgtggggactgtttgctcacaacattatcacggttaaggaaagaagctggttaataaaacatctttttgtaaactcaaacaaaattattgactaaggaagtggtcatcaataaatgataaaactattaggtgagaggttgatgggaaattgagtctttacatggtgtcagactgtaactccacagtttcttgccaggcagagagaacagacataacatcaatggagagatcaagctttcactaccttagtacagtgagtcactaattatgtgacaaccagacaccataatacagcatatgatgacacatcaacttctcagcatgacctatgaagtgtttttgccaaaagtgattaacctgaaattagcagagtcctaggtcccaactctccctttacaggaaatacaagggatagagatagaaattaaataccaccagttaacatcagaaaaattcatcaagcacacgttctataagacaactgactggttacttcaacaagtcaatgttacaaaaagaaaaagtgacaaaggagtggaaaaaaccatattacaatgcaatgtgtgattctagagtggatcccagtttgaatgaaaacagccgagaaagacactggaagacaattgaggacatttacgtatgggtcagcttttagaatcactcagaaattattatatggttaggcttaatatacttaatatagtattgtagttagtagaaaactgtcccaacttttagacatgtataaggaattatttagagtttatagcttatatgtaaataattgacttgaaattacataaaaacagatactaaaattatggcaaagatgttaatgctgattaaatttggagaaaatatattaaatgtttatgattctattctttctaaattgtatatgtttgaaaaattctaaaataaaaatgaccagtggcagtgtacttaggactcatgctaaaatcatttgagatgtcactctgtgtgcaatctggccctatgtttagtgttgtttttagtgttctccaattatttcactcatttaaaggctgtatccagaaggggtcagtaagctgcataaagataagcaccaagttttatacttgttttcacttagcccaaacactcagtgggtatgcgagtaaattcattccattaaagatgatagaaaggactttcttttcattatttgctattacattatgtgactatttattgccctcctttgttcttatcagaggaagcagagactctggttgtgtgtctccttatcctatgaattagttgattaaatcagtccaggcagtacccacttgaagcaatcatgaagccagtcaaccggctggttagagctagtcagagatcacccaccaccactgctccagattttctctacatgtcagataatacagaatggaagaaaacagactgtgtgtttaaataccaaatgggtccacgcagtgtattttttaggtctccatgatgggccaaatatatttagaaaggagaacattatgacttaaatatgtatcaagaagctctcaaccttggtttcagtaataaaaaggtgtccatcatgttaatatcattggattaattgcaccacttttttttgaatcctctaatcaaatgtctcatgcttgtcatgtaattgttgaaataccagacttgattgacagatattgcaaattccccaagggtaaatgtttccaaaggaaaacatagtcatttcaatacagcaattaattataaacagccattaatgacaagtacacaggtctctctctcaacacagaggtcagaaaagtaaggtttttcctgaaagagatgaaaagttgtggttaccatcatacagatataatttttcaaaatattaatgaaaatgatacaatcatttattttcacccaccacatttcaggaaacacactcaatactctaagcatattttttaacagggttgttggtgtggggaggcggtgcttttgactaaaagtcttgtatgctagcaacattattttaaataataatactaataatagttcaggtggggattaaaatataatcaaaacaaaagtaacaaatcagtaagttggtaacatgtgaactgaagccttacatggaagactacatttttcaatggttttttgttttcttggaagggcattaggtaaatttagcatcagatgtcatcagtataaaataatgtaaaatattgaatcaaataccctgagaattcaaggcagaagtagcactatatacatatataagagaaagaaagggagcagggcggctttgcgttgtaattgtctggatgaaagtcgtaatttctacatcactcttaatgtacagaattaaggtccagagtcaagtctggacattatcaggaattgccactactgattagcaataatatttaacaaggaagcaatggaccacacatgggaaaggaaagacactgttgtgaaatgttgacaggaatttatttcttgtccgcaaaactggccgaatgatttatatattgtagttaggaatcagacgagaaccttatgacaattgggaacagtatggattatgatgaggaaacaggaagcgtttcagaatatgttatccacatgtattataagggtgacttttaaggaaaaaaagaagtaaacttttcagtggcagtttagaaacagttgaaaacatgcaaatacagttaacagtaagcacagacatatttaagtcaaagctagaagtattttaaagaacctaaatatctatatgtgtgtgtatatatatacatatgtgtgtgtgtgtgtgtgtgtgtgtgtgtgtacacacacatatagtgagagagccaggtgaaatccaaacatcagaatgtcttcaacatttttccagacatcaaaatactcgaacaattttgcctcatgcatcaaaaataagaattctatcttgtctctcttcccactccaaaccacaactctgaaaggattttccaaaaaattgcttttatcatgttacacctgaaccagataaaataaaataaaattaaattaaaataagcattgatggcagcatatctcaccactctaccacatcaggtctatgatcgccaggtagggctctattccaacatgcttgtcaatatatgattctcttaaactctatatgaatacattttcttcagtttctacttgcagttcttctgcagggggctcagattaaaggatctgggtggagggacaatttctataaatatcatctttatcaccccatccctactggcaccacattcactcctgttactactaatactacgatcatgaagcttacttttaaaatttgaactagctttctccaatcctttcaactttagccaaaaataaaagcctcataacaaactgacccattagggaggttcatcaattattacttaaaaaggtcctaaaaatctcggtttaagttggaattccttctacaacttattatgttaaatttaattgttgacatgctcatctttttttattagactataaaatttcaatggcagaaattatgtgttgttaatttctcttcctcagtgcccagctaatacttaggaaagcatgttatataaaacaacaagtcatcaacaggcatatatgttacaaaaaaactcaaggcaaggaaaataaagaaacacaagtgggtttttggcatgtcattttcaggaaaaagcagtgagtagatcggtttttctaaaatgaagccctctgagttggcatgtagagagagaaagaattgaggtggctgttaggatgttgcctacaggctgttaattatcgccttatttgaaataatcattttactattcagaacattaatttaattttaatggactgacattatgatggtttaattgaggttaaacagtgaagtcttatatttaattaaaagtaaaaaaacctattatagagtattataaaaaccctgtatgtgcctgccaatttttaccccaagaattagctagaaactctcttttcaattgacagtgaaaatttgttctgcaatatctatttggttttacgtatttgttttaaagagtatattcagagagtttcagagaaaagtactaggccaattaattggcaaattcaaaacttcagagttttggccctgcccttcagccccactgcaaaaacctttatctatacttataatggacttttcactgcagctgaacaaaaatgccgcatcttggtaccttatgcatgattttcttatcctaagatatctgtgtatagcttagaagctttgtcttttgacagtaactacatgacattcatcgaatctggtggaattggtaaaataagaatattgtatctctaccaagagagtatcagtgactaaatcttatttttcaattttaagtcattattaagatcctaagaaaagcccagccaaaatatggagacagataagaagctctgtggggttctgagagaagagatgaagctggcccaaccattgtctgatttttttgctctccactgagaatgaaacacatggaaataggattgaaaatgaaacaagaatcagcattggactaacacagctggatgttaggcaaatgcttattatgtgtagtgtttacttttccagaggagagggagacagttgtaatacttaagaaccaaacttctagaaatcaaacataattctatttatgcttctccatcccccaaacagtaaagctcacctttgttaatgtttcttgctttctcaactgtgtttcttgcactgtgctaatatgccttttatctacactatgttatttaattcttttatccaccatgtaagtccctcactacaagttctataaggctgtgtaatttgcccaaattcacacagattctaaatggtgaatattgggctcatatccaggtcattccccaaagtctaacctcttaatgactatttcacctgctaatgaatattcctacattaaattataatacttcattgcaagtaggttttttgtgtgtgactgaatccagtggagttaaaagggatcttcaaaaggcactccgagcacccttatagtttcagcaaaatgacatgaaacctctctccttgtacctctcaaaactctcctcctctctaaataaataaataaatggatagaggttttttcattttatagcacaactttctttagttaaccattccaatatttattacctcttctgcttgtgcctgcctccttgtgtgtaattcaataccctcaaaatgcaatttgattcaaacagctggtccagggatgcaaagtgcctgtcttattctgggttgagcgagtgactagccctgggctggctgctgtggcagggcacaaagaaatgacctcagcccataaggagcttaaaaactagtagataaaatgaggcatttacacattcagcatatagaggctatattgcctgtgtgtaatgaagtggtaagttgagtaatagactaatactaaccagatttcagacagcccacttgaagagacaggagtagctgagggtgtcttcctaaatgagatgaacccatcattggccttgaagaaaactagcttttattgaatgctctctatttggcagaaagcgtggtatatggtagatacttcacttatacttgcttatttgatcttcacaaaatgagcattattatctttttatagtttatagaaaatatggttcaaaagaaagtattgactgtgtaaatccacacagtaagtttttgaattaggccctgtccaacttatctgaatctgtccatctatccatccatccccatccatctatcttttttttttttttgctttttgcattactttacaattgcctccatgattgctatatcttgtgcagtaatatttacaatttcttgcacagaatccgttgcttttttgctaatagctcttctgcttttctttgtaggactgtcccacctcagttctcaatgtgtgttcttcaggtagggctgaaatcttcccatcaactctaggggtgaacaatcagcaaaataagcctcgctgaacacagcgattatttcagctggtataattggtcatttatgtgtgttgagagaaaagggccttctttctgttaaggatctcaactctgaaaataggagtccatggtttttagttgccaccttgctaccgaaaaatgagagggtatttgagaaagacatcatcagagaaaaagcaaatgtcaagtgacagggacagaaagatttgggcactagcatttgcttgcctggtcatgcataaattaactttttatttttgtctcaaccagttggatttgatgttctgccatataaaatcaaatgagcccaggcttacatggagggtattccaagaggggttgacaatttggaggtgacaggatgaaccaaggttaatgatgaggaaaatgacacgttttaaatgaaggcattaaaaatgtaaggctaaagtgaagtagaggtgttacataggagacagtagagcccaaatcccttgcactagctttcattctttgcaataaaggagaattcggttgacccatgaggatggtgcagtgacatttaaagcaccacagcaaaaatgcactgaatattaaatgcactgtagaaataatgtgcatcgtatgtttgtgataaaaagaaagataaatataattgtagagactctatcacaaatagaaaatctcctgtgaaatacacttatagaaacggtcaatgttttatgcatattaaaacattctccaagatgatacaactgccagcagcaccatagttcattttaaaagacaaatacattctaaaaataaaataaaactagcaaacacattatttgttcaaatagtattttgaggtcaaccaagatgcacttctagttccttgcaatttgagggatttttataaaacagactttcaattgagattttgagaaacaccaaggcaagttaaaatcttcatgactttattcaacaaaaaggtggcagcaattttttaaattttgtgtgaaaagtcctacaacagcaaaaatgacctataaaatagttcaaataacagcctcatggcaaaatgactttttcattctcctaagaaaagtcaaacaaagtataaatctattcaaacagatggacttaaattgcaagcattaattcaattcaaactttggtgcattgtctaaaaatcgctgttgagaaatagctttaagtctgaattatcaaaattagtaattaaaattcctaaaacaatccaattcaacagttactgagcaattactatgtgccttactctatttagtatttaaaatacaaataaaattcatccagtccaccaaggaatggccttagtatcctcgtctgtcatataggaatgatgatggtactcataggattgttagaatgagtaaattagtttaatatacataaaacacttaaacagtgactggagcttgacaaatactctttagagggtcattattattgctctgtgaataggtatattcacaaaactgtggaagcattgaagaggtaatggttagttctgtcttgggactagaaaagtcttcaccaagaataaataatttaagtaaacctttaaggatgagtagaagttcactaaatgaaaaagtgtgggtggcctctctagggagagactgatgggtcaaaattctagagccacagtagaacttgatatgttcaggaagtgatgaacaggctgcatttgatttgaaagggtactggaattttattctctagggcataggggataatcaaatttgtcttttttggcagactagtggtataacaagaattagttttaaagttgcccctaaattatcatgtgaatattatcatgtgaatatacatgagtagcatcatatgaaattagaagcacctggcttcaaaccccatctgtcacttagtgacttctctttcctgaaaatataaataataatacttaatttggagacctttcacttaaaagagacatttttagactcccatcatgtggcaggcactctgtggtgcttttctatatatatggtgataagtatataagatttttatattataaaagtgtcagacaatatgattactaatgtgttaatatccattttaaagttttttggtttaattaataaacatcaggcttggttacactcattaatgaaagaaaatatgaagcataacataagcaattaaaatagtataacaataggataataaagcacatcatccatcttcaacagccatcaactcacaccaaccttggttcatctgttgctccacttacctcctctactttctggattaaattgaagcaagttccaaagaactattaattcatttgtaaataattaaatatgcatctccaagagataatgactccttgaaaatatcctaatatcacatctaataaggaattaacaataattatgtaatattttcaaatatccagattctgctcaaaattatattaaatttatttgtctgaatcaagattcaagtaagattcatatggtagttggctgacattgctaaagtctttcttgatcttttcatctcttgtttctgtgaaatttttattttgttgttgtattgttgaagacacgaggttgtgtgtccggcagtttcaccaagtgcagattttgcttattatatctttgaggtgtctttaacaagatcttctagccccaatactttctgtcagttgttggttagatctagaggtaggatcaaagttagatatgtctttttaaacaggagtacttcacaggctttgctgtgtatgtttatcaggaggcacactatgttatttgatctttaatcttgagatgattggtaattatcatttaggactgacaaaaaagcaatattttaattctatcatttcttcttcttttaagttgaagtacttctatgaacagaaatcttcccttatcagctacttggttgagatacaacaggtaaattattgataattaccctttatttataagcttttaaaatcgtatgttgatacctcaatagtctccaaaggtaatcaaagagccttttaaaatatcattatgaatgaataaattgagaaatatctgagaacaccaagcttactagagctcagatatttttcatctttgggcagtgaaagctaagtcaggtaggctcttgaatacttttgggaagtttcttgtcaacatataagatattccagactcatgtcatatatttccttctgcagacctagaattcattatttctccaagaagccctgggtttccttttagtggaaaatagaacctatctagagaccaaaatctaggagtgcagaatgcttattgctattgggttgttcattatttctaggtctttacattgacagagcagaggatactttttttttttagaaaataaaatatattataaatttatactgatgactacaattcaaatttagggttacagtattttaatttaccctcatcaatccttcatttttttttttacttctatgtcaaaaatcttggttttcagcaacataaatgtgattactcatttgccttaatccacactacatataaaacactcactacaaaattaccaccaccaatataattatcaaaaacacagtttatggtttatagttcctgaagtttattttgtccttagggtatatctcagtgtagatatacagtgaaaatactgtgctttataatcatttgcaatagttcttccttctatagtaattccaccaactggatatttaatgaagtttatctgttttctttactttcagaatttagatattgtttttcaaatctaaattacatttaataatcacataaactatatatgtgaactcagagtcaaatcttcaaagactattgagacatgaaaaatgttggttgagctgccacgtttcaccaagggaatttggcggggtggtcactaaattcatgcatttttgaaatttctagttttagaaaaagactgagggctcacccatctagaagcagatctagtttgagaatgaagaaagttggctggcaccaagcaccaagggacagtagcaatgtgaaaacacttcagaaactgctcagatcatttttgctggaagaaaaagtacactaccaagtaatattttaataggtatttatttcatcggaaattttaaaaaatcagccacaattttcttctacctttgtgaaattttgcgtgtgatttacgagttggcattaagagatcacttaatacttgctgttctgccctattctttggcattctatcataaacattttccgtgtggtagcatattcttcctattttcattttaatggctgcatactatttcatggggtgaatggaccttaatttaattagtctgcactaccgtaaaatatttaggcagttttcccttttcttttttttctgttacaattatcttccagtgaacacacgaagctccataaaagtaattttaagcgctttgctttagctgtggcagcagtcgcaagtcgtatttttgatcatctgggtgcacaatactttaccaggtcttgctcaccagttagataaaatatttgctagttatgatgcaaggaagagcaaaaatagtaaatattattttgaaccagctgccaagagaacagatggaatcccacagtatccaaaacatttgacctgaagttgtcctctgtgaccagatccatttcttctcaaaatacatttttcaagcagtagttccctgaccagtagaaaatgctgcttttatctttctcttcttttgtaaatcatactgtatgctatcttgttaaaacaccccatgccagagaagtatgaatgaataaatcttcctgcagatctaggtttccttcaggcataactaaacctggcaaacacactgttaaaatgaccagccacagcactggaccccaagagagctctatggtcttacataataactgcacaacaatcaaagaggccaatagagggggtgagctgggattttttttaggtagggggagggagcggaagtaaaaacagaagaaaatatgagctgcagggctaattggatgtaatttggagatttcaaagaacactgactacaaggtttgaagaggtgcagtatttttgaatgatgaggcaccagaaactccctaggtagcattttgaatttaatttaaatgagaatccagtatttgtgcaaacctggggctgttaggatgcaagactatcttgggattggcattggcaaaccatgcacagagctgtgatgaagaaaccctgtcagaagacggtgcattatggctttagagagtgaatttctagacagtcaaggttgtgtgaaatggggtactttcagcatccctagagatgatgtcttggttggttggatcttggattttgcagattactgatgaaaacattttttggagatataagggactgaaggcataatatgaaatcttactttcaaaaatttctatcagttaagttcaaagagtcattttggggcttatggggatttataatataagtttgtgacaggtgacattattttcttatactgggccttgaattagattgaataattaactgtgatttaagatttgaagaggccagtattttctaaatactaaaacagtggttttggacgttttatgcttcagagatttaattcctgcaagattaatttctttgtaaaacccaaaaagtatctatattttgaatcagacatccagattctttaggaagcaatttttcaccaaagataattgctgctgagatttaaatggatagaatcctagtcaccttggagcatgaaacatgtctaattgtcccatcattttattagaatattattttatttaaaattttgccaacttcattaagacataaagaccaagtgagaaagagcaattcatctaaaataattagctggaatttttcattcatgggtcttttgccaaccttaatcattaacctggactttaacaacttgtgcattcttgctgacagcctgactctcatcttgaactctccaacccaactgaagtttttttcttgagataaactgcacactgactcttcaagtatctgaacggcgggggaaagcttagacaaatagattagtaacaatgctcaggtgtgttgagaaatgggcgaacgaacggctgtccttgactaactctctggatgctcagagagacatttttattgtttcgtgcagtccttgtttaataccatgttttgaaatacactgcaaagttgacaagacgaacagtggagaggtggaggtcttcttatttctttgtctttgtggcaagtgtcaaatctcactttttccctaagattcctagaatgcacagctaagaggaaacatgagaatttatctagaataatggcttaacaattatttcatcatgacacatgagacagctggtggatcatgttgtgcacctcccatgggttattttaaatagttcctcaggtgtttggaatgcgcagccaaatttgtgaataactggctggtggaaagaagatggcaccatatcctcgttgataagataaaagctttagagtagaaaattgctatcattaattttccttcaaactttctctgccccctcttgcctctaagtcagatcaattgtcagcctgcttctctgccttcgctgaattgacagttgctaacacactgctaatggctaactgggacttattgattacagaaaaacgtttggctcattcaaaatcaaagtgataacatgtttgaaaagatgcttaatatatgtatttaaaaacagctctcacaaaagattggttaagggctttaagatacaaagagctgttattaacaaataaagtggacttgggtcgttaacgggtaatgtataagaaaattaaaatgggtgataacattttaaaagaagtttgcctttattaataataagataaatataatttcaaactataacagcatagcactgtgcattaaatctcatttaattggcaaaagggcaaaaatgatgcctggcagtagtgaaatagtgaggtttctacattgcagaggtgttgctaattggcacagccactctaaagaaagattagacgatatggacctaaattcattaaaatgtgtataccgttgaagcagcatttctagtagttagcataagaaaataatttgtcaaatattcaaagatgtttatacacaaatgttcatagtaactttttaaaatattcaaaataaaaaaaaccctcagtggacaccaatgaataagttttgaatatcctttcaaaagactatgagatagccatgaaaatcaatgatacagatgcaagtgtatctatataaataaatctttaataaatatacagtgttaagtaaaaacaccatactataagaccatatgtatgtacgtatgtgtacatatatacaaatatacatacatatctatgtaacttgataaaatttggacgattataaatgaacatattagcaatatgctccctgagatgatcgttttttctctctctagtgctctatattttataattcacttctaaaattttaaaagaacacattattaaatttctgaaaatgaaaaattcctttactttagacaaatgtaacaagaaattatactatttcaaaacttactggtcgtgacctcttaagagtttatttcagtgtctttgaaaagctcagaaagacaactggaactagaaatataggcaggggttttttattctgtccagttcaggataatactaataaactaaaataattccaacgttataggacaagcaaagtctgatttggaaaggtcagtttatgaaatgagagtcgagttaatagcaattctcttccccctcaccccattccattataatttgatcatttaaatgagaagacaaatatattattattacgaaagatgttattaggattcttcccatctcaagcttggtttaaaccccaagagaatagctgccaaccacatccagattccaaagagaggcctgtgggtgccagattaccaaagcaaggtttaccaatgagatagccaagagccagttttacaacccttaaacccttagctgactgtccacctctgatctatagaagggatttgacagattgagagaatgtggtgtagattacaaaagagttttagaaaagatttgtaaggatactgtgtgcccccaacctctctgcccttctggtccccacccctccctaccatgtgggagggatgaagatgcttctccctgatttcaagtctaaaaatgggagtctcgattgaactatctggaacatttgatatgtgtctccctagagctagggtgctgttgcattggtatctagttgatgcctgagagatcaaaaggcttgagattatggctggccagttattctcattcaggacaaagatttgctgcaaggaaaactgcttaaatgcccagagtttatcagcatatagtttatgttttttagggaccaaatgtgaccaagatgggaggtggggaaggagattctggagttgttttaaagggggtgagaaaacctcaacagaaagagacctgtgttgaatgcctacggctgctgagcagagagtgaggagctggaagaggtcatttgccagctcgcaagtaagatgctggagtttccgacaaacccacacatttgacccactgtgagtcccctctaaaagcatgcctccttccgagacagcaccactcactgcaggccacgttcccctgctctaccccgcctctatcctgaagaaacctgtgaatgagggaggagttaacaggagaaaatgaggagtttttcctcaaggccagagctaaaggaagagacatggtttcactttaaactaagttgagcatttggatgactctgttaatgatctgagagtacttttggggactaaagggactggagaaatctttatgatctgagaatgaccagaaaactcacagggcctgcctgcgtgtccagtgtcaggaaaaagactagcgaaagactctctctcctttatttgtatttatcatttaaactaaatcatacatatcaagacacttcacttctaaaatgtaccatgcacctcttaagaatagggacaattgctttcaggaccacactaccattattgggactaaaaaaaaatcaattatcaataatttccaatcatctagtgtctggtatatatgcaaaatttcccaaatgttgcaccagtgtctttgtagctgttgtcatttattcacttatgtatttaattagtatctaatctggttctaattatgtttctttagtctcttttggtctagaatattccattcgttgctttttattccactccattttttaaaaatccaggatattctttttatagaatatcccataatttgtatttggttgattgtttcatcttgttgcaattaaatatcttcttctatcccttatattttctgtaagcttaaataagttagcttcgggttaaatattttttctctgtcttttttgcaagaatagataattgggaatgctttcttattatgtcatatcagattgttctgatattagatatctaagtgtatccacttggctaatattgttactttacagtttttcctttgtagttcataagaaatctaattctgtggttggggaattgtgagtactctgctcccgaaccatttctcaactaatggttttagcactcattaatgatacattcttaataaattacaatactatggacttgaaaaatggtaattttataagtactatatatatatatttgtatttatcagagagtttttctctaaaagaagtttcctttttgttttccttttcttttgtttgagcataactgtgtaactatggacttagggttttttttttttttttttttttttttggagaaggagtcttgctctgtcacccaggctggagtgtagtggtgcgatctcggctcactgcaagctctgcgtcctgggttcatgccattctcctgcctcagcctcccgaatagctgggactacaggctcccaccaccatgcccagctaattttttgtatttttagtagagacagagtttcaccgtgttagccaggatggtctcgatctcctgaccttgtgatccacctgcctgggcctcccaaagtgctgggattacaggcgtgagccactgtgcccggccagggggttttaatttatatcaatgggtttcaattaattaccattgtgattacttttgctgctaaaattatcccaaatttgacaaggaatgttccttcaggctggctcttacatccatttttgagaggcctaataaatacttgctctctcacttattccaggatctccttaccttacaaacctcagacatagaattagctatttctccatatagctctggttcttttcatgggcaatcatatttagaaaacaaaatctgggtgctagatgtgcttactgctattgggatgtcattgcttctaagtctttttagtgggcagaactagaagatatattaaaatggaaatcaattactttgcattgatattttcattaaaaatttaacattatagatttgttttctcctaactttatttatttcatattggtttttctttctttttttttttttttttttttttgacagagtctcgctctatcacccaggctggagtgcagtggcacgatctcggttcactgcaacctccacctcccagattcaagtgattctcctgccttagcctctcaagtagctgggattataggcatgcaccatcacatccagcaaattttttgtatttttttagtagagacagggtttctccatgttggccaggcagtctcaaactcttgacctcaggtgatctgcctgccttggcctcccaaagtgctcggattacaggcatgagccaccgcacctggccagctggtttttctttttattacactgaagatctaactttttgtggattttattttattttttatttattattattttttgagatggagtctcatgtgtcacccagactagagtgcaatggtgggaccttggctcactgcaacctccgcctcctgagttgaagcaattctcctgcctcagcctcccgattagctggattacaggtgcacaccaccatgtctggctaatttttttgtatttttagtacagatggggtttccttatgttagccagactggtcttgaactcctgacctcaagtgatccgctggccttagcctcacaaagtgctaggattacagtcatgagctgccaagcccggcctttttgtggattttaattgtcttaatgggttacaatttgctttatcctaattgtttatatgtgtgtattactattaaatttactgagtgaaatttagatacaacatcttcttggaatacaagctttgcagatagatttaaaaatataccccactaaaatgtagaggtaatactgtcttcaacagatatttgaaacaattctttaatctgcatggtcttatcaattaagttcatttggtaaaccaaatgaattgataaaaccatgcagattttggcacttctgcctgtgttttatcatctgctatctttttcttttaggtaagattttgtttctcaaatatgaaaagcttttacatagttcaaaagttaaatgaatataaaaagtatattcagagaggtctcattcctatcctgtcctttctacccaagtccctatccttatacagagccatttttttaagtttttttttatttgtcttttcctattaccctatcattaattggtgaatgaggcagaggagttatttgcctgaacacacatggccacagagtggaggagataggatttaacccagagcagtctggttgcagaagtaaacccttagctactttgcaaacggcctattaaagtaagactgtgggggaagacaggctttgaaattagcaggttttatcacttgctatctgggtgactttgagcaaattccttaacttctctgaggtttattttacccacttatgaattagggataataatgtttactttgcagagcgtaacaaagaatagagataacttaagcaaattaagttgtagattgtcaggcacatagtaattactcagtgaatgttacccattattataactagtaaaactataatagtacgactcatacagaagaacactagaaacttttattgttcagttgtcactgaagtatgtgttgatctgatctatgttatttagtaagattaaaattttctaagagttgatgaacttgaacaaaaagcaaacaagcctgggtttgataatttatggtttcaaaaatgttaaaataatctcagagggctttgctgattttggttcatttttcaaaatagaagtttcaatattttagtggaaaagaatgttttactactactagaagtcatatagaaacaataaggtaatttctagctgaagtgagttttacgtaaacttgtttaacttcctcattgttttttttttctgtttgcaatataagatattcttatgctcctcatgttttaaagaatttttattctgtgttgaacacaaagaagtttgaaccatgcagaggttgaatttaatttgtataaaatcctcttaatagcatggtctaattaagacacccattacattcatggaatgctaatttaatttggagggaaatgtagttgagcactattgggtttaccataaaattaacacagtggacataaaatggatgtgcttattagatattgttatcagaaatattatatgaatgaaaatcacaatactgctatcttgatggaaataattgttttacagaataaggcatactgtgtgattaactagctaatttatatgaagctatatgagcaagactgttagtgaccgcttttctgaagacaaagattattcaatcgtttttttctgacattagtaaatgccttggcccctgccttagagagtttgttatattggtgaaatttatcatggtagattgaacacattgacttgtattaaggcagcagatctcaaactttttatctcaaaatctttatacccttaaaaattgttcaggactccaaagactttttattgatgtgagttatatccattgctacttacataaaaaattaaaatgaagacattttaaaaatatttttaatttatttaaaatagcaacaataaaatctcatatgttagcataagtagcatagttttttaaaacatgaggatattccaaatgttgacagacttcattgcaaattgtaagaaaattacatttgttaatatcacattcttgaacatctataattactgagaagctttcaatgtgttggtgaaagacacacgtttcagaatttgactttttgcttaaaagctgccagttattttcttcaaagtgacagattcactcattcatttttttaagaaagtgtctgctgagtacttgagtctaaccatagtttattagtcattctttcaataaaaatcatgttaatgtaaaaagcagatagttcatttcacaagtcaaacatttgcacaaatatttttccttgaaataatcactgtgctttgatatgcagcagaactgctttatataaacttcccattttgtcacagagaatattaaaaagatgtgcaacaagtagttgatatgtaaataaacctaataatttttatagcttcaacaagaacattcttatataacattggcattttctcctgcctgcaggcgagtggccttgaaaaataccttgattgctggaagagttcagtgccaaatattcggtgccaaagacactagcagttctacccaaaattccttttgcatcattggcaccaatgccaatacagtgaaaaagtcaaataatgtcctagaattattaggaaaactgtttagaccttgaggaacactacaaagtgtcttggagatccccagggctctgtggactatactctgggaacgctgtagtaagatccatgtttgctcagatgtccttgaatcaggacagagaaagcatttacaaagaaaggtggctctgtttctgctacggatgcagactactctccatgctccctgagaatttggggtactatgagcctttgtaggaagatgcaaaacttttctggccccaaatcccaacagtatacctccttagatggtttttgatataagacttttgtgtcacaaacagtccataaagagggattcactttgaatatttggatggtggaggaagtgagggtgggtagaatatgtaaagaggctcaaatcacaaatcacacaatggtggaacttttgctatcgccacatacttggaaagatgactggagatacaaatatagaaggaaccatttgcaaactaacatagtacaaattgtacttttcttaattctttggattttattatttactttttgaagaacattgttttactttggctaatttgaacaagatatttgttacaaatgggatgagattctaatatcttgtattttaagatccctaaataagcaaggttttgtttcaaatatttagccttggaataaaacgttaacacagtataatataaataattatatttcgttaatgctttttaccacataggtgatgattaagggatgaaaagggattttcattcaggataagctgtttacaagattgaagactttaggaggatcatctgatctgttaccctcactattgtcctccaatccacacaggaattggttgagcataattcagagcaggctgtcaggggaacgactggggcccagaagctaattaatacaaatcacacttaagattttatttcaagtgctgtgcagaagctctttagtttaattaggtcctacttgtcagtttttgtttttgtttcagttgcttttgaggacttagccaaaaattctttgccaaggctgatgtcaagaagggtattttctaggttttcttctagaatttttatagtttgaggtctcacatttaaatctttaatccatcttgagttaatttttatatgtgctgacaggtgggggtctagttttattctcttgcatatggctagcctgctatcccagcaccatttattaaatagggagtccttttcacattgctcatttttgtcaactttgtcaaagatcagatggctgtatgtgtgcggtcttatttctaggttttccgttctgttccattggtctgtatgtctgtttttgtaccagtgccatgctgttttggttactgtagcgctgtagtatagtttgaagttgggtagggtgatgtctccagctttgctctttttgcttaggaatactttggctattcaggttcctttctggttccatataaattttagaatagtttttcttattctgagaaaaatcatattggtagtttgataggaataatgttaagtctgtaaattgctttgggcagtatggccattttaataatattcttctaatcaatgagcatggaatgttttccatttatttgcatcatttctgatttttttcagcagtgttttgtagttctccttgtagagatccttcatctccttggttagctgtattcttaggtatgtccatttttttgcagctattgtaaatgagatgtgttcttgatttgaatctcagtttgaacattattcgtctaaagaaatgctactgatttctgcacaacaaaagaaactgtcaacagagtaaacaacctacagaataggagaaaatatttgcaaaccatacatctaacgaaggactaaaatccagaatctataagaaacgtaggcaaaaaacaaataatcccatcaaaaaaatgggcaaagggcatgaacagacacttctctaaagaagacatataagtggccaacaaaagtgaagcaaaatgttcatcatcactaattatcagagaaatgcaactcagaaccacagtgtgataccatctcccactagtcagagtgacttttattaaaaagccaaataataacagatgctggtaaggctgtggggaaaagggaatgcttatacacagtggtgggaatgtaaattagttcagccactgtgaactaatttgtaaactccagtttggagttttctcaaagaacttaaaacagaagtacggttagacccagaaatccaattactgtgtatatatccaaaataacataaatttttgtaccaaaaaggaacatgcaccactttgttcatcgtagcactatttacaatagcaaaaccataggagcaagttaggcgcccatgagtggattggataatgaaaatatggtaaatatattaccatggaatactacacagccataaaaagtaataaaatcatgctctttgaagcaacatggatgtgctggagaccctaatcctaaacaatttagtgtaggaacacaaaaccaaatactgcgtgttctcacttatagtgtatattagtctgttctcacactgctaataaagacatacataagactgggtaatttataaaggaaagaggtttaattgactcacagttccacatggctgcagaggcctcacaatcatagctgaaggtgaatgaggagcaaagtcatgtcttacatggcggcaggcaagagagtgtgtgcagagaaacgctcctttataaaaccatcagatctcatgacacttactccccatcgtgaaaacagcatgggaaagatctgtccccatgattcagttaccttccactgggtccctcccatgacatgtgggaattatgggagctagtcaagataagatttgggtggggacacagccaaactatatcacagtagaagctaaacattgggtactcatggacataaacatgggaacaatagacattagagacacctagagtagggagagagggagggggacatgggttgaaaaactacttattgagtactgtgcttagcacctgggtgacagtttccataccccaaacctcagcatcatgcaatatacgcatttaacaaacctgcacatgtacccctttatctaaaataaaagttgaaattatattaaaaattatttcataaaacaagcaagttgtcaatttgcaaagaatatttcaagtttaaggcctttattctgtactaggatcttcaaaagatactagacaatttattttttcttttatcaagttattaccttaacatagattgttttcttagttgtgaaataattgtaaattccatgtatttcttttgggggataaatgaaatttcaaatggatttctattggaatcagttgacatctggaattaaaatcttgctgaagtttctgtgattccatctaagatactagattttctttgattttttttgttcttcactgtttctaaagcaattatggtagaaacaagactaaatgatagaagataaatgagacaaataggatgtagttaccagaacattggattgtgcaaaatggaacatttcagctgctatttctatcactagaacattatgacttcatgtggattttagaaaagtaataggtaaacgattccctagctcaagaatctctgaggacagctgaaggcctggagaccaacaataactagagggattcagatgggtgctgggcttgcttgctgaagcgtgcttggctgtgtcctggaacgctgagtagagtctgaagctggtcagagaaggtcataccctatttggcttttgctgttgtaatcttagaatcatgttttcccttattctaacagcttatcttccttgcccattttattagatgccaaactcatataatttttttaacctctaaatatctacttgtataggacaaaaataaactttcagcagccatagtgtatgaaggagtatctgtgattcttccatagtgtagataaagagaactagagaggatacacctcgtcatgcctcaggtcaagtcagcctcccctaaggctctagcggccatcagattgtagtggttatttcctgttccctcctgtctctgtcctccctccccttcatcagggcagcctgctgttcctcgacatcatggatgttgatggtagccccagctttgattgtctttctaccagtcaaccacgcaaagaaggagggagaaaactcttttggagaattccttggcccaatggaccaggcatctcttttcctcagctaagctttccttcttggtatgttacagggaaaggggaagcagtttgccagacagcaagtcaacccggtcttggaatgaggggaaggaggtttccctcggtcccagtaacactctagcagggccaagcattgaaggagtctgcattcaacttgcagaatctgtttagcactttctacacctccatcaggatgtattttattctctggttttagtttcctatctggtttgaagaggagaaaaataaaagtcatgaaacatatagcaagcacctgctccctttgacataagtcagcttgttcaattctcacaacaatcctataaaagagctgctattattcccatttaataacaataaaacggtggctcagagaaggtaaacatttttctaagttcttatacttaataaatctaaatccaaatttgtttttcattcttctttccatatcacactgctatatagttactatgttatcatctcacaatcactgatcaactccgacctttgtcttttttcctgataagtcaccttgttcttggcattgctttccatattcgtggctagcagtgtccttcccagggttagaggcaatgatgagttctttttcttgtgattgctcagtagaaaaggcacgaatggtgctgcaaacctaagacacctccaaacgttatacacttttgctaatagcaggaaaaatgacctctggatgctgccaaagtgagcactgcctttacgtatgatagaaaatacaattatacattttaaaatgatctcacagtcttgctttctaacttgaattcactgtcatttaactgatttataaggattcttggccacaactaaagtatattttaaacttataagtattctctaatgaggaacttttaaaagtccagataaaagcccactattcagtagttagaataattcagtgaaattaaccatgtaaatgctcaatgaagcaaatgattaaagaaggaatgaataaaaataaagattaaagtggatcaaattatattttgtctttttttatactgcttatagatcataattaaatagtggtggctcaaaagcacaaaaccaacctcatcacttaccaggtgtgaaaataatgttgatgtgtatgcttagttttagcgtgacaaagcagatacactttttcacttttaaaaaaaatcactcaatgcatcattctttaatgtttgcttttgtgatgatcactgaatatagaaagtcttttgattttagaataattttaagtctttgcctgctgataacctcagacacagacctgcagccagaattggttgagagttctgctatcttctccaatgagggatatttgagtatatactaaataatcatatttatatactggcatttaaaaaaccaaatattctcatagttctcttcaacctcctgagctccttaatatagataatatagatggccacatttttgtcattatacagtcatgaaaagaagcctatgtaggtcttatccacatttacaagacaggaactgaagatcaaagaggttaagtgactttcttaagttcctcagataaacattttgaaacagctgagatgaaatacaggtgcgctgacttcaaagcacaagttcttttctctagagtgcactacccccaatgagttgacaaaattaaacaaaaactaagcagaattatattttcttacacatacttcatacaagtaatcattaagcagctacttggtactaaagtttctcccaggaggttgcagtgcagatgggtaagtaagctgctgtatgtgcccccaggccataggcatgtcagcagctatggataccacagtaaaataaatgactatcgagaaagcaggaggaacagctcaccaggggagcacagtgatgaagtgaaagcttcacctttcaggaattctacacagcccataaaaaaaaaaactctatcccctccctttcagagtgtttcttaacaactgcttaacacagaaatcatcaacgtattgttgtagatactgggattaatatgtgcagaacttcaaacagaacccagatctcatgactccaagtagaggacctgttccaataacccatgaaaataatcacaacatcctaatcatgttttcatccctgttttactttattagttgttaataggtccattggtcactgggacacccacatgggggttatatacctgttcatacacaagctatgagtctttgaagacagaagcatatgaggtcctgattttgctctagtatgaactcaaacaaattttttttcagactagtcaccctcatctttcaaaacatcagatcatttcagagctgcttctaggacatgtgaacttgggcagagagaattgctttttcttcactgtgttactgtagtgtaccagtcatatggctattctaagatctttaatcctcacttccttgtcaccctcatgaagggtccttcaaacttcttgatgacagccaggggcagggagggcactccaggcagcaagctgacacaatttacaaaagcagttatcttctctcccgtgaagcaatgccgcctggtagaacaaatggtgcaacccatgcacacttagtttatccaccttgataatctaagtgtcaaggacagagcaagtaccattcataagactctctggagcatgcaggatactgacaagctttttatttatgacccagggtttaacccatgtgagctcatactttgtcttctgctaagccttccatagctccatctcaagtcctcctttaaggtgagggtcactggactgcatatcattcagttcccagctagttttctcttcatttatttgtgattttactcagattatgatattattagtttagaaggggttgctgtagtcaggacaatcagtaatgcacttctaaatactaggtagatcctccattctttgtggttaaactccttccaggttctagtttgtttgtttatttatttattggaagattcatacactttgcctttcttttcaccaccttggtttggtttacaagaaccaaagctagtttctctaaacccacttgattagtgtgtgtttgtgtgtgtgtgtatgtgtgtgtgtgtatgtgtgtatatatatatgtgtgtgtatatatatatatatatttttttttttttttttgagacagagtcttgcgttgtcatccaggctggagtgcagtggcatgatctcggctcactgcaacctccacctcccaggttccagcgattctcctgcctcagcctcccaagtagctgggattacaggtgcccgccaccatgcccagctatttttttttttttttgtatttttagtagagatggggttttactatgttggccaggctggtctcaaactcctgacttcgtgaactgcctgcctcggcctcccaaagtgctgggattacaggtgtgagccagcgcgcctggcttgattaatatattttatttctactacatcagacacagattctttttgcccaacatacataaccatgtagtcctacctaatatagtttcctctgtgtgtgtctgtgtgtgtgtgtgtgtgtgtgtctgtgtgtgtgtgtattatatatacaactagtaggaaaccccacatatccacatatctttctagatatcttatctccctattacaaaactcctctctcttgattattacactttataattttactccctatgtcatccaaagtgggactctcattgctgatggtctaagtcagtgagaccctgttgccttggccatatcagagtctctggatgcagggccctggaatcaccattttttaaaagctatgcagtgatgttactgtgaagccaggttcacattttcagcctttagaaaaggcctgttgacctaagttggagaatgctagccttgtccccaaaattgcctgtcttctgtagttattcagtcaatatttattggcaacaatcatgcaataagcaactcaaatgaaatatcctggctaatgtgggaccactctggcacctctgaagttagaggacgtgctactaacatttatcatttcagatctttctgatcgagtgggtaaaaaaagatactggaccattttagttgctatttcactgattttctgagactaggcaaacaaatacacaaagttttctccctccttctgctgttcagtcatcacaaagaaaaattaaggcctttgtatatactgagcaaactgttggggtaaagttataaaaatggcagacagatcttactttgccaaattaagacatttagcaagtattgtaagtgtgatgagtgacgggaataagtgcgggacacacttgctttgtctgacagatgtactaacctgattttgatctgccagagtacaggattcattccttccaggtgcattattccaaagtgcttttggctaaaaggcctcttaaaacctcaatttattgttctctatatagtatatttctatttgccatctctccattattttcacagctatcttgtgtcctaagttgggccctaagaaaaacaaactgtcctaaaccataggccaagatacctgaagaactgaggtggtagggcatggattttgggaaaacttttttatggaaatctctgtcttggaatttctctcaattagcagttcttgtactgtttacagcacgagaactgaaagcataacctgcttctcttatgaggtaaactgcatattctgggtgaatgttttctctccacaaaagccatttcacatgtttccagatcaattttgaagttgttttgacactttacacactttattttaaccttttgtttctgagtgtagtatcctcacctgtctacagcatgaggaattgaaggctctaccctgtctgtttgcctggcagagctggggtgactctgctgcttacacaccagccttcccactagactgaagcttgccaaggcaagggctctgaatgtggaagtgtttccctttccagggccctaaatatttctaacttgtatggcacctgggaacaaatcaaattatcttcttgactccaaatgaacctccaggccttcttagaaaagctgaaagaggaattaaagggggataatggctcatgcctgtaatctcagcactttgggaggcaaggcaggcggatcatgaggtcaggagtttgagaccagcctgaccaacatggtgaaaccctgtctctactaaaaatacaaaaactagctgggcgtggtggcatgcacctgtaatcccagctactcaggaggccgaggcaggagaattgcttgaacccaggaggcggaggttgcagtgagctgagattgtgtcactgcactccagcctgggtgacagagcaagcctcagtctcaaataaataaataaataaataaataaataaataaataaaaagggggagaggggatcaaaagcactagtctgcatccattcagagctatgtgtgcaatggggagtaaagccagcctagaacctgtgcatcatcccaggtgtgtttccagtcctcccttcccaccatgagacaaaatgaatggagacaaatttagatcctctaaaatgagaacaggaggccaaaatggtgggaatatataaacgacaagggcacatatcacttgctttactttagtcctgagatgcccaaggccagactccatggatgagtcttggggcacttttggtcccactctcttagccgtctcccagttcctgcaattcagaggaactccccaaattaattaatctgatgaactctgttctcgagatgacagtatctccatattatctgttcccaagtttcctttcaaaagggacaaatgaacaaggaggagacagcactaagtcctactcatttccaagtaaagcatatatatgctatttcccagcttgggggcaggctgggcaccctttcagtattttatgtctgcatctttgaatgagtctggttgttctctcaagggagttttactttatggctgaaaggaaacctgaagctgatttcttggcctttctctttaactcattcctctttctcccaccaaggtgtctgtaaagattctctctggaattgcctcgcttcctaaaagatattttaaacactaggagtagtgaatgcctactcattttatcaaggaggaaactgaaattcaaatcagaggagggccttgactaaagtcccatggacagttagtcacagttcacacaatggaagtccaagcccagttcactttctgctacactgccttgcttgccataacatcatctttcaattagccgtggtcgttgcctcctatgtatattcaacagaatcctgaagaaagcaagctgaacacgtttccaaattagcgagagcagctctgaataagaagaaaattcatggtaagtttatgggatggctccaggtgtccatctttctatcttcccttgttatcactttccctgttttgggtgtagggggagaaagaatttcccattggctgtctcctggggtgagcaaaaactgaatgtgtttaatctaggttttcctcagattccacgacttgtaataagcacatctttatactcttacctctccagctgttctctgtgcaaagctgaactaactaaaactgctgaaaataccagagctatttagggaatttccctaactgcttcaacattcttaaagtgactaatttaattggatttatagggcactacataataatgatatcctttggctatgttcttagtgggttctacacctgtaatgaaatccataatgaaaaggaaaacagaagtacatttgggatgcaaaaccacttaatttcctggacagccattaaaaatgtggcatccagtgcaataccttaactttgattttaccttcagacacctatgatgatgattctggttgttggttgtgggacattagaataattgtgtcagaagaattcccatcgcatcctagattcacacagcatttctcttactggaaacccaattcattagtcatctgagttggaaaactgggactctaacactggatgttgattttatttatttaatcttttgtgttctggtcttatttctgttgtatttggggggtcctgtctgctatctcctgttcctggtgttgaggtgtagtgttctatggcatttctgcatgtccttggactattttccaaggaatatttgtttaacaaacatccttcaaagatagaggcagtataaccatgaaatgtctccctccagggcaaggttagacaggtttgcttgaagctcccttcatagattgttttctagctttgggatttcttggttttggcaaaatatctatcctgtgagttgtatcaccctgagtccacttctacgtgactcccactctcgtcctccccatgacacttgagtgacaagggcaactgatcaaaacagaaagctcatgctgcctcctgtgttctccttaataaagttcattgtctctgatccaggagtctcatgtcttctgagatcatctatgaaactagcaggttaacttgttggctagcaagtagggttaaatctcagacccttcacagttcttgacacccaatttcttcttttttggagccttagccttagatctagatgattaagtcctgctacatgatcttcatcccagtatttctcccttgcttaagtggctcagcccatatttccagtaccagttcccactaaattacccactaaatgtggttccctccctgtggtcacaaggaaatagagaatttttgtagttctctagaatgggcaggacagacatatttgaatgtatttgcccattctaattatttgatagtgacagtctagggcttatgatggagggattcagtcgttgtatctaaattcagggtgaaaggattgcatgatcaataggtaggtataagaaatggtctagatacttaaagtccaaaacatctgcatcagggctccagagtcaggtgcacccaatgctaaatgatatgaagaactggtaattagagtggtacatacatacaaagtgagctatttttgatgatagtgaagccactatccatttaagtaggtaactactctggttatcacagaggaaaatgtgggaaaatatgccaaattttctccaatcctttctgtaattcctctgtagacgtgcaagtatgatccttctcatgaggtttaagggtggaaaagcacaactaacgtgggcattagtgctataaagccactgttaatttaacaagtttatagaatgtgctggtaatttacaaagtttaaaatggtgacatttctgtctattttccagtaccaggaaaatctgtaagtctcctgaacatttaactttttaaaaataaaaactgtggtacttgttattaacatattctttgctttgcctgttagaaaacctaggaggaattttttctattaaccagaaacagttctcaaactctgatacacattagaaacaccagaaaaatcttaaaattactgatacttgggtttcgccaccccagattctcacttaattggtatgtaatggatcctgagattttttttttcttttttttttgagatggagtcttgctctgtcacccaggctggagtgcagtggcgagatctcggctcactgcaacctccgcctcccgggttcacgccattctcctgcctgattctcccgagtagctgggactacaggcacccgccaccatgcccggctaattttttttctgtatttttagtagagacggggtttcactgtgttagccaggatggtctcgatctcctgacctcatgatcggcccgcctcggcctcccaaagtgctgggatggatcctgagattttttgaaagttcatcatacaattaaaatatgaagcaatgatttgaaaaacactattttataggattttaaactgtctagaattcagttttggactagtatatagtagggatcaaacttttattttcccaaatagccaacttttccaatgttatttatatcttctacttttatttagtagtttttttttcatcattgatctttaaaatgatatccttataaattccatatatctgaatctgtttctggattctctatgttttccacttggtttatttgacaactttttaaccagtatcacaccatttaaattactgcagatttatggagtgttataataactaggagaacaagttttgccttattgcactattttttcaaaatattattggccatgttatacattttatttttcagagaaaaatgtaggagatttcgatcaagtttcatcgtctgatgttttgggccatagggaaccagtcagtctctgtattccagtttgtgaagtacggtgttttgattggtcacacctgagtcttatgatctaaccttggagcaccgtctgagagcacacgatgtgagaacaagaaaggtggttttgggagatagaatgtggtgtcagaactatagagtgagaaaaattagagatggggatcctgttaccttgaagggcagggatgcctgttttgatgcctgaagcatccaaacccagcaatatccctaattttattttgcttttatggtaccaagaatgagtccaggagataattttaaatggtagtgctccaaaaagtgatacatgtacgctacatgaagtggttacaaatgaactattgttgttcatgaactccacatacccatcattaagtgtgcttttcaatactgcattactgtggctgccttcaagattgtgctgtaaaatttccctacattaacttttcacttattcagagcatcccattagtttacatgagagaaaaggaattagaaagataaggagtctaagaaaccttaatagatgggagaattctattaagtaagcataatcaggcaaggagtctcttggaattgaattggaatttcaaggtcacaagtcctatcaatccgctccctctaaaatcaccttctcatcatcctagcagatgagtcctccatccccacatcctacataactgcttcaataaactctcattaaggattccattgaagataccatgttttttcctatctcagggccttggtacatactctttttactgcctaaaaattccctcaccttctttttttccttttgtctagctaactataactcatacattcaatattttcctggtagtattttcttagaaatacttagggagcttagagtgacattcaagctccttcatagtttgactaccacctatgtattgttttggtctatctcctagtaagccaggctagtcacctaaatgccctcctttctcctattgtttatggttgtgtcacttgcatacattacctgcttgtagagcagccctcccactcaggagtaataggttttattcctacgaactaacatgcacttgacttgtacttagtcacattttgactagaattacagggacttgaaggtatgtgttgtgtctggatctgcccatatgttcaaggtatttcttccaagtaagtctgcattactccagggtaagcgccagacttcctcatttttctacctttcatggaacttttgcgtgagtggcaaggaatactcaatggcagtgtttctcaagctttaccctcatcaaaatgacctggagaccttgctaaaacacgattgttgcaaccacccctcataccctgtacccaccaagcctaaatccatctcagatggagcccaagaatttgcatttcttataagctccagtgatatttaggctgccagtgctaaaatcacactttgaaaaccactattccgtgacactgttttaaaaactggttgcatgttaaaatctcctagaaacggttaattaagattttttttttaaagactgtgcttgggctcccctctagacaaatcaagatctctgaggatgccacttttctcatgaaaagaaaaaaattcaacaatccgcaactgttaggagattttaatatgcagctagtgttgaaaatcactgttcatacaaatggcagatgagtaagcagagtcatgaacaagagagcaggcttgctgggagcctaggccagagcaaatgtcataacctcctgaggcagcgtgagttagggcatgcatctcacattttaatgtgcttgcccggaagatgacgatagtaaatctgggatgtctctgaaatgctgctggtctaacaagctcccagatgattcctatccgtgaaccccactctgattagcaaagttgggatatccatgaagaaaaaagggtcagtgcgtgcaagggatgacaaaggcaggtgagtgaaatggggcttgagagcccacatccggtaatcctttagaatttcaaacataagaaagaaggggaagtgctggggggtgggttcccctgtggaggaagttacttctaagccatcagtttaagactttaagtgaatttctggggaaagcatccagttttgataagtctggcccagactaaatatataatttctacctaattaaggaggcaggcacacaggcaaaaaggtaaatgcagcttctggaggcacatcctaacagaaccccagagaaattttatcaaagtctgtgggctttctccatcttcttagctgccttcattgagaagtaaatttccatgggagaaaattagggttttgcttcattcccagtagctggcattaaattagtcctgtagaatgtgtttggagatcatgttgatgagcagagattgtctaagcagcaggtgttacgaattcatttaatcatttaaccacacaccctgcacatatttcagctttcttaggttgacttttatttgcaaaacacctatctgaaggtgtgttatagtggatgtataattgatggtgcttgtcgaattttatgctctataaatgccagatacattttccccaagtatgctctttcttgatccatttctctaaagtaaacatttgaaacaaatttaactcttgagggattctggcaggactcactttctcactgattttagagcttgtgttcaggttggggagagagcattatagtttccagactcagctcagtgtaaaaccatcgtgcccagacaactcacttaaaaggaacaggaaagtgcagttagagagcctttactccacccatctagatgccaggctaccaccaatgggcatcttgttttccctcttttctctctcattggaagagagagagagagagagagaaagagagagagagagagagtgtgtgtgtgtgtgtgtgtgtgtgtgtgtgttttactacctgtagtagtttgaatggtgacctggtgaccctcaaaaaggtatgtctgcatcttgaaacctgtgactatgaccttatttggaaaaagtgtcttttgcagacgtaattagagatcttaagacaagatcatcttagattatccaggtggattctaattccaaggctaactgtccttataagacacaaaagaggagaaggccacatgatgctggaggcagagatgagagtgatgcacctgtagccctagaagcctccagacctggaagaggcaagggacggaatttccctggagcctctggagaaggaaactttgtggagcctgtggaaaccgattttggacttctatcctccaggattgtgacagaataaatttccatttttctaaaagtcacccagtttgtagtaatttgttatagcaaacccaagaaaatgaatatactatgcatcagcttggggtcgggaggtggggcacagaaaaagaaaacaagttcccaggccctcctaaaagtcattttgtttaacatttgatccatgcatttgtcatgccctccaaaggggacttctgcagaaaagttctcagtgtccttcaataagatagagcctttctttgctcctaccctaaccttgaatcaaatacagcttggtgggccctgacgctagaggaattctcagtggctgggctggcggagagctatctatttgtgtatagggttgcagccaaagtctttaaactaaaactaaaactctgtggattaaataaaatactggacatgcaaaagaagattctcttcgggaatccctgtgtactagcccctctgtgtagtgaatgctatcactttttcttctcgcttttctagataggcatctagaaaggtgttcaatctcttgggggtaatccataggcctccagggttatttccaaaagtcttgttgatgttatcagtgttaacacagaacctcttctgattagtgttcaatcttactatggaatagcttttttctctcaaatattattagaaaattagtaaaacataaaaatgatcaggtttggccagttttacccctactgtcctactgctattcaaagacctagcacttctgtacatacgagtaaactgcactcgaaatggtattctctgtttctgcttctacttaggttccaaggcaggtaagcagtctaaccagatgacaggtgagcaatctgaggtgaagtgacttcccattacatgacttttgacccccatcgttgtcttggaaatactttatgctaagtattagaaagaaggaaaacctactggctgttgcaaacaatttaaaataacttaaagtggaagaaagaagaaaaaagcagagtgaaattttatagggtggggaaaacctggaggaaactttcctttgaaagccaggagtccaaactatagataggatagtacagaaattcagcaatccccaagtgttctagcagaatttaaaacagaggatgaaacttggagaactctgggctagttgtgaccttcagatatactttaaaaaaatcaactaatattttaaaatcagtattttcacataagattatgactttttttttcttttgaaaattttgtaagatctggcagcattgggcctttattgctgcattgtcaggaactgggctatgggtgttccttccagttgagggctgtttgaggtctactctgtcatctacctggccagtcccagcaaagctggatgtagttaaacatggaaggcacaactggactaggggaattggataagtccttgaacaagtacctgagttaaaacatcataagttaaaaggaggggatactggtgtgagttctgtttctcaaaaatgggtgtggagttctaaaattaatgttaatttgggttccattttttccaatttccccactctctgccatattgtattctttgacttagcattagacttagataagttagttaatattcctgtaacttcggtgcttcatacacaaaatgggaacaattataactacctcctaagattttagtaagactgaataagacaatggataacaacgacacagcataatgcctgaagcatcataagcacttaaatgttggttgctattatgattggtattctttaaaaagtgctattacttgccattattgacttttgaaactggagggttcaaacaaacaagatgttgagaggctcaggcaaccagtatggttggaaataataagaaagttagttacctaccgtgatactacactaacccttgaaaaaacgtgtggcgtttaaagaaatttctgctaaatttctgtttggcttcagcaaaacctcgtgttccactttcagagcatgaaagaggcagttaaggcaagaaaagcgcatttagaagtttaaagaatgcaagtatcctatgggttgagaaatgagattaatccttccttgactagtgctctttttactggcaggataaattctttaggaaaaagagttatgctggctgtggaagtaaatagtgacaggtgttcttttgtttattttctatgtatttttcaaccccaggtccattttattctcaaatgtaacttcttttcttagtcaacctgctttttggtaaaattgttcttaaagcattcagcttacataattaaatatggttgtgtggttaccttttatatccgaatgtaaggacctccatataatctaattattttttccattaaaaaaagatatttcacagacacaagctataggtaaggattcattacaaaggaatctcattgttttaaatgagcaattccattatttttgattctgccgagagtgggacctaattctgtcaaagagagaaggttgttaagatttggtggtcagaaacacatgacttccaatcaaatttagcagtcctaactatcgaattaggtgttgtaagtttatgtgggctttcctaaggtgaattgactacagggggcatagttctatctaaggaataattagttatgttgagattcaatgttatttgcatatttgtgtctttgaaattcctctgaaaatgagtaatttttagcaattattcttggtgtttgagtccattgagctagtcaaaaatttataattgcaaaaactttggccaaattatcagatagagctaagattcggtttggggtcttaggaattcctattatctccttgaactttgggatgtatcagttattagaatttagacagtcaacgagcttgttgaaattttttttggaacaagatcagtggaatgaatggaaacaaagaagggcatatatttgtagaggaggaaaaggagtgatttgcagaagataaaaaaggaagaagataaaggagaggacggaagggggaaataaaattcacataaattgcttatcactgatattatagaagtaaactattttataacagtatctgcaatttattgttcacatagccttcaaagaaagaaagaaatgaagcagtaaatcaccttgcctcaaattataattttccttacttgtgcaatatttattgagcaattttatgcacagtgttgtgtttagtggtgaggatatgtagcaaataggacaaaacttccgtttatactggtatagtatgtttgtgcacatgtgtggtgatggtgccaagtgactgttgtagaagaatagtgaagaatgaacaaattagaaagtagagaattacaatagagaaggaaggcacatgagcctctcaggagagcttaattctattgctactttcaatggacaataatattttcaaaaggtattaataacttcaatacaaggagtctttcagcctaagtggtcaaaccaagttaagagaaaaggaaaactaaaaataaaaataaaaaataagatcaactttataagcaccgttttgatctcagatctttgtggtaaggcttgggaaacaggactttgcatatgggaagatcataaatctgggcctgtcagggatttgaagagcccataaaagtcagtactaggtgtctctgctgtgctccgaatctggaagattaatgggtaatttcgacttcctgctaattctttatacaaccaggcctatatcttttaagatccaaaagatatattaccataaaaagtttctaagaaaatgtgtaatataacctattctccttctattttcacgttctttctttttctcctgtagtcatcatcagacagttaaaaagaaatggatttttgtcaacttgaaactcaagcttgaataaccagaaataggaatcttccccattatgtttcaaaatgattttcagtgtaccctttcctaactagtcataatttagcttgagaatttcaaatattaacatattagtcattagttggtattatttcaatttttcattcttgtttaaataaattcagcttgtcagctccatatactaattactgtcaatggttttcttttctctataatttaaagtcataaagtagtaataatttagttctttatacatagtttgagcataacccatcgtgagaaggcaagatgtaatcatcactaaacatatttgtttttactaaataacagtttctaaatttgaaaaacttctctgtgggtgatatgtgaggctgacacattgagcaacaccatgagcagatgtagtagcatacgtgaaaaaattggttaagcttcttgatgtttaatgaaatttaagcacaaaaaatatattcatgtataactacttttggcttaataattcatgcatttatttgcctgtaaatactctttaaacttctgttatgtgcaagatatcatcctaactgctataaagcttataaaggtgaatcaggttcaacttctttccttaaataatttacagtccaacctacgcatgtgtataaataatctaccaccagaaaatgctaaataatctaaatggggcatttttaaagtgttgtgtgatttaaatacgtatttgtgtgtgtgagagaatatgatatatgcattcatatatttgagttgaaaatatatacacatttgtgagacagattagatataagcttaaaatgtgtatgtgtgtgcacatgtgcataggagtatatgtgtgtaagggggtaacaaggcgttcacaaatttcattaagagactaccatttgagttgactttgaagcacagataagatttggaagtatggagataaaggatatttgacaatttgacatggtggagagagtatatgaaggtatgagcagagtccagcaggctgacaaattgggacctgttgagaggacaatgataagctgtcttggctaaaagataggagattaatgagaaagaatagtggcaaataagtttcaaaagtaagtgtgtttcagatgttaagtttttattatagatattttgatcttcagtttattgaaatggagttctgagtaggagcaaaggaataccataaaggctacaaaaatgctcttagttaaaagcaggatccactagggttgggttggaactgaaataggtgtttaaattttcagtatcttcagttttgtttgtttttactgtgcttagactgttggatcacacatataagactgcaaagcgctcattaaagtgaaaatatatgcagacgtttatacccggtataacagataaattgagcatctctctacaggtgtatcccaattttttgctatgtatacccttagtggatacctgtgattgaatgtaattattatatcttctggaatgtgagcatacactgattgatgtcagacatttagactgtgctatggtttggctctgtatccccacccaaatctcatcctgaattgtaatccctgtaacccccacatgtcgagggtgaaacctggtgggaggtgattagatcatggggtttctcccatgccgttctcgtgatggtgagtaagttctcatgacatctgatggttttttaacgtttgacatttcctcctacacactctctcttctctctcacgcttctgctgccatgtaagacatgccttcttccccttctgccatgactgtaagtttcctgaggtctccccagcaataagccaggtgtaactgtgaaccaattaaacttctttccttcataaattacccagtctcaggtatttccctattgcagcatgaaaacgtactaatacagactgtggctaacaataaattgtatgtggcaggagggtttcagagtcttgtcatataaacagatatgagaagaggccgtggataatttaaaattccatagcaagcaatttttttttttaaagattcaaaaatgaattgtaagaaggggtgataaaaggaccacctcactggggactattgcttaatctttgcattggctgcacattgcctcatgcattggagacagagcattatttctgactttaaaaaaatccccacacaaagccaagtaatggggtttagtattaggcctacttctattttttttttcctcagagtttgccaaatatttgattttttcagaaaacaatcacccaagagtgcattcattgcttcctgcagaaatgtgccctttattaaaaatagtttatctgggacctgcagtgtgttgaattgtgtcctctagaaatacatgttgaagccctaacctctggtacctctgaatgtaatctttttggaaatggattttgcaatgttaaaaaatgaagttatacttaattaaaatgggccctaaatccaatgtctagttttgttataaggagggggaaatttggagacacttagatgtacatacacacagagggaagagagctgtataaagacagagggagaaactgatgcagctaccagccacgtaatatcaagtgttgccagcaaccacctgaagccagcaaagaggcatggaacagattctctctcacagtcttcagaaagagcatggccatcaacaccttcatttcagacttctaggctccagagctgtgagagaataaatgtatgtggttttaagccaccttgtctgtgctactttgttacagcacaaagaaagatggtacaggaaggaagctggtagagcacagaagaagctggtataggaagctggtacaggagccaagaaacagggaaggaaataggtgggctatatcgtgtttcctgcctgatcattatctccaataaacagatgtgtacattaagagcctttgtaacaaatatgcttaatatttacaggatgcatatattagctggaaaaaaaattacacttttttttctaaaaatattatgttctatccttgacacctgctcagagcttctgcagagagagatttgtgggaaccctgtgtcttaccaaaaatcagcaatcacacaagaggtgtagtgtcctccacaaccctagtttgtgggcttaagaccaggtgccctgattagatcttggacatataatactagaaagactcactcagtacttagtatggcttgttcaagtgttttataggaagtgcaaagggcttagaaacaatagaacttacttgattcctgactttgaaactcattagaaagtgaccttgcactgctgaggaaactctccagacgtcattggtaataggagagtttttaggaggtgaactttaatgtcccttttagctctgtgattcaatgacttaatagatgaataattttcctaaaataagttataaagaatccaaataatagaactagaatttacagtttacttggcagtaagtactggctctcaaataattttaattagttcttgttgaattatgaagtttattttatttgtattttattataaatgaactgcaactcttacttttagatgattttgctaagaataaaggaaaaggaagtaatttgaatttcaaatttttagcccatcaaatgtgaaatgaatatttaaaggtgaacaataaaattaggctgcatttttgaaaaatatttctgcttgctaaaatcagaattatacagccacgacctttaaaataaaagacagaatttcagataaatgcagtggttgtagattatagtttctggagaattctgccccaaatgatatatgctcattcatctttcctttcaaagaacaacaattaaaaaaaaatctttcagtcagttgagtgttctggaatgctaaaataatatgaatggcttccactcttccatgttaaagtgagtcccccaaaggtttacaatctttgatgtccagccatgcttgacttgacatttgaaaattctctagtaaggaatcaaggtaaatggagcataagtttctcttagcaaatttggttttgtagatgtcatactacatgcatgtaatatacatgacaattactccacagattggggcacatgtgttaatgtcacgagagcatcagtgggaaagaacctaaattttgtaatgtaatcgtagtgggatggcagaattatcacataatttatatgataaagcaaaaggaaggccgtgtccctgtaaggattcaggcaatacaagtccacacagagcatttctccatcttagacatctttgcacatcttatttcatccacattcattagctaagtaactcagggatctctgtcttttttgttgctgtttgtatgttctattctgctgccccaatctttagctgatacaacaaaagtatgagtaagaaacagggcatttataacgcactgtagactccatggcatttggacactcagtaatgtgttcttggtactttatgagaatgtgcacagtgatggggtttttgcttagccaaggttttcttcattcagcaacatcatgaaaacgtcttctccttaataaaataataacacaggaatgaagatttctgatacacaatgagcccaggggttgacaaaggaacttaatctttatgaacttgggctctccgggatcgcgccgttgcactccagcctgagcaacaagagggaaactccgtctccaaaaaaaaaaaaacaacccgggctctccaggccgcgccccgaggcctcaggtcggccggctgcccctccctctgctctgttcctagcagggctggaaaggcctctgccgctcagtggggacccagcaaagccaaaaatcaggtccgggggaagagcgaacggtgcgtgatggaggctccgagggggagcgagaggcggaggtcgcacagtgtcctgaggggggagactggaaaagcagacacgcaaccgtgggaagaaacccgaaggagtaaagaactcagagcgaaagtccaaaatctcctcggcacgcgggcctccctgcgggggcgcgggcaccgctgcgcggggagctccggagctgcagagaagcttccactctgcccgcgccgccctgagcacaggcgatgggcctcggagggagtccgcggagcgggacgcctgctgcttggacctcggcgtgagacttcgcgggacgcagacaacttgaatgcgtgtgtcagacccgcgaccactacaagacaacgtccagagacccagccccggaaatgaagaaagacacttccggttctcagagggcgccgttcttccctgagaacacggtccagggaggctggatggccaccgcgtccacggagagagcaccccaggagctccagaaagaacgtgaccacaacgcgcagaaaccaagctgtgaggccaaggtccagcctttcccgcatggcgctttggctcctggggttctgcttgcagcccacaggggccctgaagtgccagggggggaccttgggccaccaggagcgaggcaggccacgatttgagggcttaggtccagagcacctgctgctttgatgctgtttccctcgtagccgggtcctgaatgcccagagactcggcagaacatcagctggtgctactcgccttaaggcacttttgattgagttcttgtcagtttagctactgttcattagtttatgcggaaattgttcttattgaagtttgatgaatggtgttaggtttgtaaggtactgtttttcaaataaagacacatatatgtgtatacatgtacatatccatatatatggtacaggaaggaagctggtacagcacaaaggaagctggtataggaagctggtacaggagccaagaaatagggaaggaaataggtgggctatatcgtgtttcctgcgtaatcactatctccagtaaacagatgtgtatattaagagccttgtgtgtgtatatatatatatatctatatatatatacacacacatatatgtatacatatacatatatacatacacatatatgtatgaaatgagtgagctctggtttattgattatccgatgactggcagttattgaataatccatcttccccttgtctatttgaaatacttgctttctcatattttagttgtcaatgtgtcttggatatatttagacttttgaaaattattttccagtgatttattctagccctgccccaacaggacccgctgtaattttggttgttttattatacatttcaatgttatttaggacaagtccctgtcattattcttcttttgtatacatcatatacgtgtatgtacatatgtatatacatatatgtctatatatacatgtacagatatatatatatatatatatatatatatagagagagagagagagagagagagagagaaactgactgacttgggctctctagagccaccctacttggatgcaactcccagatctgccacttgctagctgtgtgaccatgagcgatttacttagtctctctgtatactgcatgccataaaaagtagaattggaatggcaagaggatcttcctctgaggactgagttaatacatataaagtatgtagaacatcacccttaacataataagcactcgataaatcatagatattattattaatgagagcttaaagatgggtaactagagagacaatctggggaaggagcgtaagtgtgcatcatctgcagacatcacagggagcaattgtataaaatgctacagttgaatcctcacagtttgaatattttaaacttgagatacccagattgagattctcattgtggttggccaatccagagcatgagaaactgaatttcaattattcatatttttgcactcaaagctagctctttcagagctgctctctggaactcaggcaaaacattacagttaaattctgaactcctttcccttcttctcactgaagagaaaattaacaagaagcatgtggataaatgtaaagcaagcagaagagtcataacccttggagagactcaagagtatagttcagtagaaagtcgtcatgtctggccaggcgtggtggctcatgcctgtcatcccaacactttgggaggccgaggcggatggatcacctgaagtcaggagtttgagaccagcctgaccaacatggtgaaaccccgtctctactaaaaatacaaaacttagccgggtgtggtggtgcgcacctgttatcccagctactcaggaggctgaggcaggagaatcacttaaaccagggaggcggaggttgcagtgagccgagattgtggcactacactccaacctgggtgacagcgagactccgtctcaaaaaaaaaaaaaaaaaaaaaagaaagaaagaaattcatctttctttttttgccacgagtagccacaggcacaatcggggatggagaggaacacagatggcatagagcatccaaaagatggcatagagcatccaaaagatggcatagagcatccaaaagatggcagagagcatccaaaaggtggcagagagcatccaaaagatggcagagagcatccaaaagatgggatagagcatccaaaagatggcatagagcatccaaaagatggcagagagcatccaaaagatggcagagagcatccaaaagatggcacagagcatccaaaagatggcatagagcatccaaaagatggcagagagcatccaaaagatggcacagagcatacaaaagatggcacagagcatacaaaagatggtatgggggttgctgaggggactctggagtcccctgaaatcgcataggtctcctataaattcatcagtaccttatattacaacatagtggtcaaggaaaaaaatgtatgctgaaaagtatatttgaatgttgccacagtaagttgctttcctggacctagccctgtgactggaccccagtaaccagagaacaccgcacccaagttaaagaagtgagatagtacaatcagtccaccattcttgagctacctgcctaacagcctggcctatgcagctttttctacatccctgcacatccttctcacctacacattatctctgccagaagggaaatcagcttgttctttgcatgcacccttttttctcttatcattttttttcttgtaatgccgcctatgactgctacaagagaaaacacgacatgaagctgctgtgtccattgcaggttccttgattttgagcaaaggtggaagggacccatggcttcttcacattcgtcaaaggagggaaaggaagctgtcattggaatgtcagacctaaatgtaaacagatttcacagaaaatctttcatacttctcatttaggggaattagtttggattgtctgaataatagatatactaatattgttattgtaaactgaaattttatagaaatataagccctacaattccagatgacccccaagagaaaaatgtgttgtccatgggaagaaaaacagatcaatgaactggaggaatggtgtgacccaaccaccttcactcatagaaattactgtgcttcattcagtacatagtatatatttacattgcaggaaaacaaggtctgggatggttagttttgctccagtagcctggaaaaagcagacttgcctatacttgcagttctggctatgatagactctgtatgtctctaagcttgaatgtaattagaaatcttaatatacagcccatcgggtcagaacctcgaaagggatggatggagacacaccaagtaccatcatttttttctgagttttatcttatatatactagttattggtacttactttatatcttcagaacttagagttttacccatcactgaacacttcatcaaaatgtaagatgttatcttactccctattcctaatgcatagctcagtgctaggtacatagtagtcatttaacactgttttaatgagtagatgaatgaatatgtggatataaaatgtgtgttctacttatataaacatctcaatgcacaggttaaaaactttcaaagtaggaaaatttaaacacatttattttccattctattttatttctaacactgatataatatggcttctataaaaaagaataccaaagggatgaaaatgtagtattatctccttttcacatagctgaacagccactcatttctttttcatatgaaaacatgaagacctagacctattagtaggagccatatcatgggtatttagcaaacgccattttcatctgaaggaggaaaatttagaatttgatctctcagctgccctcagccatgttagaattaaataagtgatcatataggcaacctctaaagtcccatgtatatgcaagactgagacagagagacatagaaccagatagggcaagaggttgaggcaccttagaggttatctagaggagttttcttaggtcttaaatatagaaacttggacccagaaggggcagacagacaacatatttactcaaaataatactgttatagctgttagactaggaatgatgacctggtctcatcgtagaaaaaggcatatgatggtaaatacatagtataatactaaatgttttatatgtcttaatcgtaactatataataacatgctcattaaaacatgactagttactttttacttttttctattttcaagcattctcttgtctaggagttagggaacattttctgtaaagggacagatagtaatttgtttaagtaattggtaatttctttactggcaaagaggccacatactttgcctttgtagcgtgagagtagccatagacactatgcaaatgtgtgagtgtggctgtgttcatgggctccaaaataaggcctggctggatttggttcaatggcctcaattggactacccatgcttcatgcttttaattaatgttcatcgattaaacaaatattatgtaccagacattgtgttatttgctgggatacaaaggtgaataaaagctaattttcatttcattatatcatgccttaaactatagtcattgccttttttttaattaaaagttattcgtgaattattagctctctaaggtaagaaaaatattactttgttggtatctttctagttgatgtaacctgaaggataagctccttcttctaacatgccttaaccaagggaagaaagaaatgcaaatgaattaggtatgctttgagtttatatgaatataactgaccttcttaatatacagggcttaatattattgcttagctctacaaaggaagaacaaaactcagtgtttctgttgaaatttgccttcaaagaaaatggagtcagtgaactacagaatccttgagatcctttgtggaatattcatgcttggcaaatccccctcgggtgtactaatattgctcaaatagagctcaagggatattgagtaaatgctgctacagaggggataagacttcagaaaagaagagtacaaacagaaacttacgtttttacaaagaactaaattgtgtgagtgctaataagaatgcaatctaagtttaatcaggagtggcttgtagaagttaggtaagtacaaatctgaaacattctgataactgtaacagagaatgttctacatgcttggacttggaaaaaaattcttatcaaatgaagttttgagttttacaaatattcaataagtatagactgattgaatgtcctttgtatctttaggtcagtgacctcttgaggcttaagagaaagaaaacatttttttttttgctaagaggtggcccagtggaaatttaacaatctagcttataaagtattggtcctgagttctccagagaaacagaattaacatatgaagagatttgttatgggaatgggctcatgtgatcgctgaggccaagaagtttcataatctgccatctacaagctgaagaaacaggaaagctggtggtgtgattcagcctgagcctgaagctctgggaacttgtgtataactggggaggctggcagtggaggatggaactggtataaatgccaaagtttaaaaatgtgagaaccaggagctgtgttatccaagagaagaagaagatgaatgtcctagcgcagaaagaaagagagatcttcctccacctttttattctcttcaggcctttaaagattggataatgcctgcctacatttgggaggaaggatttttgccttctcagtctactgattcaaatgctaacttctttccaaaaccctctgatagacacaaccagaaatattatcttaccagctatctgagcagccttagcccagtaaagttggcacataaaattaacatcacacactatgaatgaaaaacctcaaaattaaacccacactcagcaaaaatgaaaagtagcctaaggtaaaacctgatacttgtttataattttcaccaccaactgttgatatgggcagaactaatgtattttgctatggaacatggctttccttatatgtgtgaaaataagaaagttgtctttgctgaccctttctttctctgtggaatgttccctcctctattctctgataggagactttttattgcatttcaagcttcagaagttatgccctttattattttctctctctcctgtattttcatcattttttacatacatgtaatgaatcagttatgttctctcgtaaatgtcgtgttctcatgtaaatatcatgttctcttgtctatttccctgtcttctgcaagactccatccaggacgagggccatttcttaacattgcttgagtctgatcatccacttagtattacttaaagcatagtgattagctcaaaacacgtttgtttaataaacatcaaggttgcatctactttcttgttgttacaactgttccccactcatctctagtgattgctattttaaaattctgattcatgtttaatatcaaaaagcctatacattttagtgtaatacttggattcctagtatccctagcttgagataacaacagtatcaaaggctaccctaatttcagcaatgcttttaataaatgcatatgcaaaaagcatttgtgtaattttgaaaagctaataatatatgtaggtgtatgtgtgattgttcagcctacagtagtcagtgtacatgtatgtttctataataaaaacctgggaattaagctgttgcacttaatggggcctttggtactgtggatggggaagactcccttatgtcaatgaaggagttacgtctttctgtagaaattttgtctctttctttctcactacagatcatcaggttgacagtattgaattgatggcaccctaataaggaatagcaattttcatgtaaataattttataaaatactttctttttgctgcttactacttacacaagagaacaaatcagttctattacctaaaagacatactaatattatttagtaatttgtcatttgggctaccttaaattgccagcagttttggtaagtgatatcagctttctctcataaaaatggccattttttttattattacaaataacatgactcatttcagggagaaaaaatataaatttaagtcacctcctttcatcaacattaggcttttcctagtcagggaccccatttaatgtctgcaaaatttaaaattatttttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggagattcctcagggatctagaaccagaaataccatttgacccagccatcccattactgggtatatacccaaaggactataaatcatgctgctataaagacacatgcacacgtatgtttattgtggcactattcacaatagcaaagacttggaaccaacccaaatgtcccacagtgatagacaatgatagactggattaagaaaatgtggtacatatacaccacggaatactatgcagccataaaaaaggatgagttcatgtcctttgtagggacatggatgaaattggaaatcatcattctcagtaaactatcgcaaggacaaaaaaccaaacaccgcatgttctcactcatagatggaaattgaacaatgagaacacatggacacaggaaggggaacatcacactctggggactgttgtggggtggggggagtggggagggatagcattaggagatatacctaatgctaaatgacgagttaatgggtgcagcacaccagcatgacacatgtatacatatgtaactaacctgcacattgtgcacatgcaccctaaaacttaaagtataataataataagaaaaattatttttatctaatcataaaatctacatatgccaacatacagatcataaagaacaagttgtatttatatttcaagggaaaattatgtttactctattacctatcataataatgcttgtctgttgttgtaagccatccatcatcttagaagtaaataattgttgtgctgtaggaaaacacatcaatatagagaatgatgatggtgtgattataataattatcacacatatcataggtagttactaccatttaattctgttttaacatattatagagctagtaaggtcacattaaggagaagacacaagatgaaagacccttaaagaattcttgttcactggaaattacaagaataaaagtctgaagcaaatttggttgacaagtctttttctggctaaactatagttattgatatctagttattgatattatgggtttaagaaggattaaaataactttcagttgggaagaatgttttaagtagtcatctaaaagatgagaaagttgaaaagactaaagacttaggaggctataccatctagatttgtgtaagtacgttctatgaagtttgcacgatgtctaaattgcctaaagatgcattcctcacaatgtaacactgttgttaagtgtcatgtgactctataatacctaggagatatagtttggatattcgtctcctcctaacctcatgttgaaatgtgatctccgatgttggaggtgaggccagtgagaggtgtttgagtctgcttgtttctgcctcaccagaagcagatgctggcactatgcttcatgtacaacctgcagaaccatgagccaaataaacctcttttctttataaattacccagcctcacgtattcctttatagaaacacaaaactgactaacataataggatttggtaatatcatggtgccaagcatccactgggggtcttggaacacatcccccttggataaagggggaattactatctctgtatcttatacctgacttagatggcagggctttcaggattttgccagtaaacataatatgtaagggctgctgggttgtgttacaggtattttatcagttgtgttgtgtgcgtttattcgtacagaatccattggtttctagtttcttgtttctgttatttaaaaaaaatatattaagcatctactaaaactttccaaatacttttctttcttttttcacttttttggagggaaaataatcatattttctcacattctactgttgttttaataaggtactagaattgatttgctaagactttgtttagaatatttgcatattgtaagtgggatatacttgtaatttttttcttcagtcctatattctaagttttcctcatggtgctattatgattttgtaagaaagaattgcatatatttctttcttaatttatataattgattcccaacatgggctgcatatcagaattttaaaagctagaaatgcaagaaattactaaagccagggccctaccctagatcaattacatggatgtagagtgtctgtgatttcagtttaatacagtctaagatttcttctcttttaacttttcaaaagaagtagacaaaaaagagcacttggaagaaaacagggttaatggaaataatgtcatattttctttctgcaagttatccctttttctgtctttctctttctccccccatttccttcccattctcctacaaagaagtgtttgggcaataaattaggtggcagtactctgcatgagtgaatagtttgcactgatactcagtgcttacctatttgtgtcaatactttctgagtatgttccatctgtaaaatttgaaatcacaagttccttctcagctccaggagataacagatgaaatatcaggcaagaaatgagaaggatgtgatgctgattgctttctggaagactcaatttgtaagctgctgggaatccatatctttcccagttgacctttcttgttataccttctgtacatttttttcctctaacataaaaattatcatggggattcgtaggagattgtctgattcttgaaactgcatttgttactttgtgcaatttatagcagctttccacaagtaatttatcagtgcttgttgtttagtgccctgtgacagatctaccagttcacactctcacgagagcactgagacccttcttccatatgcagattttctttcttgattacatttaattctggttctgggatattgctaacagtgatgtcaaggagcatggcatggtgtctcccccatgttctaaggccgtctcagctctaataacatctttctgttgtattaacctgctgttcagtgaattcttagccatctgcttctggcttaggactgtgatttgagtattgtatctagtggatgcaaagggtaagaagatagatgttaaacattctctttctctgtgtgctacttaatttgcttgacatattacaaattgtaagttcctgtgtctgtcaacacatcctcaccacctccagactaacttgcacaagcttcagtgtgttgttggcttaaatccttgctccctccatagttccacccagtgcctaagacgagcgaatagtttccagttcacatgctgattaataaacatcacatttgattagtcatagtaaatggttgtgttagaaagaaccccgaagccatgtatttcctactcagatctcatccaacaggaaagatttagtggctatttttattacctttttcttttttcttttctttttttattttttgtttgtttgttagtttgagatggagtcttgctctgtcacctaggctagagtgcagtagcagtggttcaatcttggctcactgcaacctctgcctcccaggttcaagcagttttcctgcctcagcctcccaagaagatgggtctacagatgcacaccacctcatctggctaatttttgtatttttagtagagatcgggtttcaccatgttggccaggctggtctcaaactcctgacctcaggtaatctgcctgtctcggcctcccaaagtgctggaattcattacctttttctaagtgttatgaaaaacactacttttcatatatataacattttcttattctatgaaatacactaatttacttataacaacattagattttttttaaatctgcactaaaactaaattcattagtgagtttattgtgtattaatactgcaacttatggatactcgaacctgaatttcttgaatctgttactttccactgtaatgtctcaggaaacaagggattttcatgaattatttatactctataagactgaaaacaaaaggtgtcttgccttagtttgaatttaaacttaaaaatcttttcattttatgtttctaataattaaagttagttatgagatatattggaaaatttggaaaacattgaaggaaactttaaatggaagaaaaaagactttacatgatcctatcctcattgttaaaatatttatatacattcttccaggtttttgttataatacatgtttttgtaatgtaattaaaattatcctaagtaaataatatatacatatatatcctatttgtttcacttatcattataacgtaagtattctctaatatttaaaaactatcacattatttttaggggctcataatattccattaaatgattttgtttacttcatctaaccattcctaatattgtttattttcattgatttcttgattttaccataattagcaatgccacaatgatatattttggattattttattttaccagaaattgaattctcaaaacgaaggaaaaagacattatttcaaggctgttactaaattaaacctctttttaaataaacaactgaatattataagatatgtctgtgcaatgtagcttttaaactttgtcattttcctaaaaacgtgagtcacggaggatggtagcaatgatgaccccatcctggcaggtaataaatttttaagtggctttgcactggaaagatggactagatgcgctattgagatctgttgtacgatatgtgctatgaagaagagaaaaatacaggaaatcttcagagggtcgttgatcccagtgaagtactgcatcagaccacatgctgtgtaaatgtgcccactgggatttcatctaaaaacggaggaactaaaaattaccaaaatagtttaacttgaaatttagaaagtttagattacagttaagactatatatgattatcagaagcttactaaaaacatatctcacttttttagtatatttttctgacaaagttcaaagttagtgtaacccttcacttcatgggtgacctgcattgtgttcataaaaagagtctttttggcagaaatcttgcagtatgccagcagttttcccaacggcctgtcttaatgttttgaaattcaaatttttcttctttgaactgtcattttatgaacctcctcatcagtttcctgatctcttcctcttgttaactggtctaactctgccaggaagacattcatgagtggctttgtatgtggttcttcagcatcacttttatgaaatcctggataatttgcagaaaagtagtttcataattcgacccacttgcacttgtgtcttaaagatctgattttttaaaaaaatgacagaatggaaagaaatagatgtcttttgtaaaaagagagaaatgtttgagtgaggattgatttgataaattgtcagtcaattagcaaatattttgtattttgagttctaactaatgttacaacctcaagattgtggctaataaacacgtgggtaaaaaggccatctatgtgctctgctccttctgctcagtcctgtcttccaaacacatgtaagtgtttacatttcacgataacaaatgaaccacataatgaagataatttcacactaaccatgaagcttagctctgcaaagaacaatggttcccagtattggcttcatattagaattgccttggaagcttttaaaaaatgtccatgcccaagccttactcagataaatcagaacttctgaaagagagtcccagataccagtattttttaatgttctttttaaaaggaaagtataaatatgtatttaccattttctgcatctcccatctttaataatttttttttttttgatggggtcttgccctgtcacccaggctggagttcagtggtgtgatctcagctcactgcaacctccacctccaggttcaagtgattctcctacctcagcctccagagtagctgggattacaagtgtgcaccaccatgcctggctaatttttgtatttttagtagagacagggtttcaccatgttggtcaggctggtctcaaactcctgacctcaggtgatccgcccacctcagcttcccaaagtgctgggattactggcatgagccaccatgcccagcccatctctaagaatgcttattaactgtatctgaagatttagtgcctgagattctgcacttataattaatccctatatgactgtaatataagttattctggggaacaatttgagacaatgctgatacatgcagataaaaagtagtagaaaaaaatggtggattaatcttattctatggactagcaattctcaattatttcatttcagtttttacttttcatttcccaatgaatatcataaatgcctattttcaactctccataggacagtggctacttctgtatattaaaaacgaaaactagcatatcaattgtatctgttttgtggtgagcattattggtagtataaggattttaattcagctaatcaaacattggcacatcggtgtgtgatactttatgtttttttccaaaatacagtgtcacaaccatacttatggaacaattgccattaaagtaatgtctagaccagtgcttctaaaacttggttgtgcattcatattatctggggagatcgctgtatgtcagattccgattcatatgactggaacaaggcttaagaaacagcatttctaacaagcacctatattttgataatgttcctaaatcttggaccacaatttgagtagaaagtctgcagcctacactatataaatatacatatatgtatatatgtgtatgtattaatatgtattctttcccgcaagactagatcgtgtaggatagattcttctctggaaattgagcccttataacttccccataattgaattcaattgaaaaatatatttaactactatttattaagggccttttatggacagagcactttaaacatcaaacacgtgatgttattttgtcatactcacttaacttatactcaaggagaagcagtaatttgcccaagtccgcatcatttgaattgacagaactaaagtttatgctcatactggtgtggccccagagtcaataatcttagctactaagcaatgttatcctccccggctcatcagcttcctaccgcctccttcagcccagtgttttcactttcttttgtttatttccgataatgatgaaagattgtttcagcttcatcacaggccatgtagtgcaaattgaagacggctgtctaggcaaggctcttaactattaacattgtggaatacgcacacaagaaaaatccacagttgtgattgtacatttagcacctccacccatactcaagttattattttatacttaaagaatttggatttcctatagggaaaatgacatagccatcatctccatttctgaatgaaaaagtagaggaaataaatgtctcattactggggggctgaaatacatctcatagcagctcctgtaaaggaaaaataactaacatttattgatctgcttttctatgctgagtgttgtgctagccacttcacacatagatcaccctactcagtcctcacaacggtccactgaattattatcttccacacgttacagatgaagaaactgacaagcagggattaaagaaagacttgcctgcagttaacagctgctaaatgatggaggcaatgtttgccttttcagcgaatcaatatagttaaaggaatatagtgtttgtttctctacacgctgcagataacaattttgaatgcattagatgaatttgtaatatattgtgctaaaatagatgtttttattttagaacaaaagaaaacatgtttaatctgatgatcactgcaataactctagcctgattgagattcatgagagtagttatttatatgaggaagataaactaacatttctcaaaaggcacacccaaccaccaatatgttttacatgtgatttataaaataaatattccacaaagtgaaagatatggagtgttttcattattcttgcattttaacatttgtaatatactataacatgataaatgaattaggttatattgattaggtttttgctgcagtcagtaatcattttactttcttatcacttatgcctgagagtagaaattaaacaaatggcttaattacaatgagaggaaatatctttttctattccaagtagtagctctgaagataaaaacagacatatttcactgatgtctaacttctaattgatgataaaaccatgagtatgtcattaagtctgtgtttgtcttgagctatttctggattaggtgagtttttcaaatatctgagtggttgtttctttttcattgctattgtttgattttccctaaatattgctttcactctaaccctatatttccataggagtttttgttctgtgggaaaagttctatggggaagttttattgttctatggaaaagtttgccactttactaatcctgccttcccttgccttaccaactaaagatgagtttaccaaagtctggactccggcacatgtgctggtcttgtctctttttattctccctctctctgcctttattttatttctgttcctatactgtgattatttatttacaaaagttctctattacatgtaagctcttgagggcaaccattatttttttttaatcttttaaattccagctataatacagggtttagcactgaataagctcagtaaacattggtggaattaatgattattaaacgcccaggcagaaaattaattgattgaatattactaacaaactttctctaatttgagctagacaatattaaaatggcaattaacttttcttctctacttatactctcaaatttatcatcatgattgtatattctctaagaaaattaactccataaaattagtcattttaagaggaattccttacattttcatttggatcagacacacggatgcgtctctttgaaggaagtcttcttttctcagcaggttgtttctgactagaatccatttgtatccaaacaatttgagaccctcgttctgctttagcgcacagactttcctaggagcagtcgccattccaatattgtccacggagctggaatgtaattttcagacaagttctgattacaccccagtggttcatgaaactctaatgcatggcagttgtttgagaggattttactagtgaacacctcaaacaagatttcaaaattttatttttgtggggtagagagtgaaatacagagaggtggtgctgagctctgttgtaatacaaaaaagcctcttggcttctaatgcagagagtacttccagaaagaatgataatttagtgtgtgtaaaatcatttctacctagtgtaatactagaataattgttttataaaagaccctgctgttattgtaatggcacaaactggtatgcattaggcccctcttgtttatattagaatatttatttagaactaaatattagaggactcttaggctagagatgcaatccaggaggtgagttgcctgtattttttgcccagttagctttctaagaaagtagaaaaaaaatctttattgtgtactaggaaaaacctgatgtggaagaataagggtctgaaatctcatacagctgccccacatgcaagttgtgtgtccttaggtaattttcataatccctttgataattagaactacaagagaaatttagataatctatcataaattacttattgaagatatttctgctggaatacatttttgagaaggatttattaaatgtcaccttagggctttctcactgattacaagaatgcttcaaactaatattatacagtcttaaaatttttaagaattgagatggcaaacttctactacagtacccttatggagcaaggactggagcttcagcatagaaaacctctagctaaataagctcaccgtattcaaatgtgttgacaaagtgcaggatataggaaaccattctgcaagtcatgacaggattctccgcaggtattttcccctaggatatttaaaataggatgtaattgatggaaatcaatttgcagaatcttatctcgaacacttctgttggcacatctgtacttttatagaatcgtctcttgaggcttatctatttcagtaaagtttctaaatactgtaacgtcagtgtctaggctaaagatatgatggagagcatctaaatttaaaataagagagagtgctaatacgcaggtattaataaaaacttttcatgttcctgctagtgatgtcccttatgggaaactcatgcaacgttatttcatgatgtttatgattttgtaatcactctaaactacagagccattttctcactttctgaatgtgtttattatcaaaacaacattatctgatcttataagactgggtcctgtatttttttaagagctttgagagtagatggcaataataggttctctcaccactctggtttcacattgttccttctgtcttagaagtgtaatttattccctagattcctactttttaagaattcagtattttgcctttcttctttaaaagctaattgtgcatctcttcactctgtacaatgttttcaattgaataaaaacgtgttaaaaggttagtacaacctgatgtttaggagacctacgaatatagtgaaataattcttcataagtgtaaagtacaaatggcctaatgaatatagtcctgaagaaaatgtagtaaattgacttttgaaaataagttcactcttttcaaggttgttttcataggctattcagacatgtattcagggaatcagccaatcaaccagattacaactgaactaaaatgatgaaacaagcatggtgtcaggacctagaaaaaccatgtgactaatacgtggtcccataatcaaaggcacttatttagaaaagagatgattttgactattacctgatagagtcctccatgtaacatgtacctattccatgttttctcatttaagattctcttttcatattgtccatattataaatgatataccattttgttctgtatttaggtcataataattagtttttaattaagctgatcttctccaaaaatatcctacccaattctgctccaactattccagttctaccccttttgcaaattccaacctaaatcttgctttttctgaagtctttttcaatgttcaatcatattagcctatcatgttgcttactttgaattgctctgacataatttgtttttaaacaccatcatgccatacagtgcatagtccattacagtctaatttatggatacgttttgctttaccagtgattctcctgattcacttagattcttctactaccaagagtctggaaaggaaatccgcaactctcaagccagttttcaattccctttgctttatcttgtgaacatgataaagtttcctccttctctgattcttgatattttctactcttaaaatagcatttatcatctatttcatagggaccagatagagccataagtttacatgaggaaaaaaaagaattgactttgtgttagcttcccagttcagagattctcattacaactgtattcctgattgccaaaaggccctttaaatgaaatgcctcctgtaacaaagggaggctctatgtgggctgactttattatccaacagcagggaatatctgtgcattgaaaaaaagaagaaaatgctttgaaagaatacattttacaaagccggtagtaggtcaggggagcctttgcctgactctacgttagagtttttaaattgcttttggatgaggacagcctatttttatttctttgtcatccaacattgttatgataaataattaatttgctatattttatgtttctatcataatccatgttgtgagatcactgtggcattttgctgtaatgataagaagaaataaatggtgctacaatgcttaggaaagattgtgtaatttccagtgatggacagtctgggaaacttagcaaatggctggcctgggtctcacctagtagaaaaagctcagaagagatgagttaaagcgttgtcaattgttcagtcccatcccttcaatggaagtgctgaaaattaaggcacaagtcctaagccctgctgtaagattgtacaattcacaacatttcctagacccggcaacatgactcacagattggtgctgtctctgtctctgtctctctcaccacttgctctctctccccatcctctctctgaaggggaagactccttcagaactgtttttctgtgtagcatggatggaactggagatcattatgaatttgaaattagccaaatccattcttaaatacctcagactgacatacatcttccaaggattcaagttccagctggcatttgaaaacatggctttagaggctcattcaaccctgagattctgtgattgcatgatattctagtttaccttcatcttttccattttttcttttaaatgtaataatgcttccagtgtatattagtcactgacaactaatgaactgtaaaacattttcttatgctttccatagacccatagctagagatgttgacccagtgattaattctaaattgcaatcgatgggtaattattattattattattattattattaggcttttgaataatattgaatatgtccctgaagttagaaatttttccccactttcaaagtgaaagcctggaaaaatagttaagttggttcaaaagagccaaggattttattctttcttatgatactatcctcccaggtaagattttatatctatctatctatctatctgtctgtctatctatctatctatctatctatctatctatctatctatctagatatagaatcacatatagatatagatttaatatctccaattacttgcagaaattcatggagtgctgacgtgctgagagtatgtaaatagtacaccctaccgctgtttaaccttgtggtgaaatcatgtgcactcttcaggtcatgttccagtactttaatcaagttttccatttggtaaactgaaagaccctgtatttctaatgctttgctaatcactataggagcaaacatttattgaatgtgtcttatggaccagacactggtgatgataagaacaattgtatttattctgtttccttgaatcgtcttggccataccttatcgaggtacaatatttgctttcattttgcagatgaggaaacgtagattatgaaatgttaatcaactgactcaatgtatggtaaattctttctatcttactttctcccatttagtttttttctttcatttattgaacaaatatttatttagtttccattatgtaccagatgctgtgctaaacatgaggaatataaggatgaataaaacagaagtggtcttgtcaaaaagtaagtgacggaaatggaattctcacccaggcccactttattccaaggataaactcttcaccacccagtgtgccttcctcccttccttccagccttcctcccttccttccaacctcctttccttcccttcccttccctttccttccctctcccttccctctcccttccttccttccttcctccctctctctctccctccctccctccctctctctctctttttctttttttctttctttcttgcttgcttgctttctctgtgtgattcttcctatatcacaacaaagaatgcaatcatgacagtgaatatgagagaaggttttcttcgtatctgattgactaactcccttctactacttgaggacagtgcagctcagcccttctcccctcccgtcttggattttctttcccctgccatcctagctgcagaaagctcagggacatcagcccattcaaatggtgatatcccatctttcaagatttaaccccctgtatcttgcaaaccatctcactttccaaagccccttattaaattgtccaaactcgctgtttaagtaagacatggccatttccacatgacagaatataaactgctgatagtttttgtattgtattatggggtaaagggacaaatctactgtgaccagtgataatacactcaaagattctcactgcctcaggcactttctgaccaccctgctcagggacaatccatgtctccatacccagtaagtcatgcacagcattccagatagggaagattctttgtgttaattccagtgatggctggctgtagtgggttttatttttcaggtaaccctgagccaggccctgtgggaactgaaatacaagtagaccttcctgtgagttccatacagagatctctcaggaacttgctcttttacctcccggccactctatgataagtggaagttaaaggagttggtttcactctaccactacttcactgtggtgctcagtgtgacatgttcacctggtgttcagaggtctaaaagaaatgaattctgcagtacagagagaaattttaaaagggagagacaaaaggggaaaaaacaggatgaggttagcatatgaaagtgttttctttccctccctttgggctggttttacaatgctagtgtgctagtagaatggctgctttcttcagcactttgttaaaggtccctggttgggtaagaaacttgactgcactaggacacatcaaacaaccagccaggctttggtcttacccaggcactgaaaagctgagccctgtgctctgctctcccatttgccacattttgccggatgagtctggtatgcttcagacaagcagttacacatttcacgaaggaaagaggtcggtggatggaaaattactgtcatttttagtgggtgaaggcaaagaagacctaccttctcttccattgtgagatactgtacagcaccttcgattcatgtgcgtaggtctgaattctgttttcaggatacttagtgttgtgtttgtagaattgaggagatgctacctaggggagaccatggagatccactgaagtggctgcggctgattgtgattgaatttttaagcatttactgaacattcctaatttgtctgtatggaggttaacaacaatttcctacaaactgagtcaaaaggacatattttatttttgtttgtacatgaactttctgcatcgtctgatgaagaccattatcccctctttccagatatcctcattttctttcttctaaatgtctggttgccctttctgagaatttttcattgattcctctttctcttcctagctgtgaaatattataccaggttcctttctcaccctgctcaccaactcactccttccaacttgtgtgttaatttcctcactcccgtaactcatgagaaaaacaacaacaaacaacaagatttgaatgtgttaagctgtaccccatgctgggatagttattttgccactgactcttaggaatcactgcctgatccctgctactctaaattcctgtctcagtttttgtcaataattaaataattaacttttggttatagaaaaacatagacctaagacctatgtttaccccaaaagggaactaacggcgtccatttctctctctgaagcctgagacaattttccggaactccagaattagctatgtgcttgctagtgtttcccatttgatatcctataatcaaatgtgcaaaattgaactcatcttttcttcaccctaaactcgcaattctgcttatatttccatgtttagcaaatgtcactattagctatacacatgctctaattaaaatatggaagtctttcctgatttgtttcttttcctaatacattttctacccagtgattgtgctcctggtaattagtttattgactttggctctgtcctctccatcacttgccaccttattaagaccccattattccttgtccgtgtgatcacagaagtttcctatccggtcttcttgcttacactgttggattcttctaatgcattattcccacagcagctgccagacttgcttttctaaggcataaatatagcctatttatcccttgattttgttctttaatattgttctcataagcaattattacagctggctctaccagtacactgtattttcttccctgagtgctacttccagtttccagtataggacatgagcatgctcttctgacctggaacacatgcaggctgcttgctttctctacctcactaactgctaatcatcttcagaaggcaaggtgatgcaaggaaaagagaatgcactctgattatagcctcagactgaatttccaatcccagttctaaaacttctgagctaagtgactgaaaaattacctaaccttgtttagtatcaatttttgtatctgtttttcagataataataataatagtagctactttaaaaggttagtggattgaggtacatatgtaaagttatctattggtttgacttcttcaagcagccacaactaagttccagcaaaccaaaacaaacaatttattaacaaaactctatgatacttcacaaaattaaagaaaagaatggcaaaaccagaatatatctatagatgtaaagagctaaaactgaggacatcataaccctaggaatcctagggtttttatctctgcttctaagttgcttttaattcttcatctccatggctccaagagataccatatacctagttagccccatcagaaaaactaggggcaatgactctgaatggccgagcttaagttatgtggctaacattagactcatccctatgacagataggataaggagcattaattatctcattttggatcacatgtctatctgtgtggtagaagacctgagccaggaaaaaacgcaataattgtagtcaagagcttctttgtccaatgtacaatacattcttcccatacaaaaaattacaagagtcgttctatttaacataattcaagtatcacacatgcattcatcctcttccaagtagtagaaaacttaaagtcatatccaactattgcaaccagaaccaagtttatagtatctctgggatgtgcattccttttaattatttgctcatatgttgctcattaccttgcaatatatgaacaaaatctatatgtttaaccacatctcagacatgcattatacaacaatgttgagaaaaacaagaaaacagctataaaaattcccacgtaggatagggttacagtggaatccccatatatctgttactggttgaagaaaataatatatgcatggacaagaatagtaaggagcagacattggttggcttgaacctttccagttgagtcaccattgcttattttccccatctgacctttatggtacttcttctgagcattattctttctggctgcacctgagggggtctttaggaaagactccctggggactgtacatttttctgtgcttctctagtgtagtcacaaggtgctaacagttactttagaagttagcagatgtatcttagaaacatgttggatttacttgggaattcaattacataaaagtcaaattggccacctaatttggatgtttttatgtgggtagatctggtttgtttaaaaatcaaacaaccagaattattattcagttgtaaactttaaatctgaaccctgaccttgcaaattctaaccttaataaggctcttcatgttttgcccatttcactaggacttattttaaagctttcaaccacagaatcctagattggatactaagaaaggatgaacagctgttctgaagctgggaatccctgagaactgggcatttcagttgaaggagttataatctctttctgataagtcacatcccaagaaaagataatgagagcctggagcaaggcttccaccatttctgtggctgctgtcatgtgctagactctggtcgttttcacggcatagactcgagttcaggtactaggccattcctacaacctcacctggtgacacacagagtcccgtctcttcagaatgccctttcctttcttgtctgttattcatctgtcatgaattcttcttccaggtagaacattagtttttctgtaatgaaaacatttcttctaattctatctaaaacaaaacatttctccacttatagatgataaatttagcactttgtcactcaatatcttgtgccactctttgttcctatgtgtgagtcatgctacatcaaagaaattcaaagggaagaacatgttacacaattctattttctatagcacccagttcaaggttgaatatttattaattcactttgatctagcatataaaaactaaaaaatgattagtcacgtggagaagagggtggggctagcctgtggaaagtcacagagatacaatatactcataacaaacctgcacttgtatctcctgaatctaaaatataaaaaacatttgaaaaaatctataatgcaattctgtaaaagtagagtaataattctcttctattttttctacctagatgtacctgagtacatctcccttttgctgccttgtacagtgactcaggcagtggtgattaatccaagaggggtggtggaagaggctgtgcattcatgtagaaatgcaacaaaaccaccaagcctgtgtttggctagaaaagcttcttaggatgttctgatgcttggtcctaggagacagcacttttcccttctatactaagctaaatggctggattagcatggaaaactgaaagttagaactacaaagtacctcccttgcattctggaaatgcggaagaaagcaagctgtaatcttggcatgtgaggaatccacagtctaagtgactgacaagtgcgcatgtgaggacaaaccatgatagagatgggcacagagtgttatggactagaatagaggagttaggtaagatttcccagaggaagtcatgtgtgggatgagtttaatcaaggatgctacatgaatcattaccatcgtcaacaaaggagaagttaggaggacatatttttcattgatatttttacatggttaacagtgattggatgtgggaagtgtgtgtatgtgtgtatgtgtgtgtgtctgtgtctgtctgtgtctgcatgtatcccgagatgtcattaacattccaggttaatactcattcatgtatttattgctcagtccagcttcccctccgtggtttgtttttttttaatttctagtttttttttcttcaactgttattttaagttcagcggtacatgtgcaggatgtgcaggtttgttacataggtaaacatgtgccatggtgtcttgctgcacaaatcatcccatcacctaggtattaagcctgttagctcttcttcctaatgctctccctctcccatgccccttaccaccctgcgacagaccccagagtgtgttattcccccccaacattccatgtgttcctgtcactcagctcccacttataagtgagagcatgtggcgtttggtttcctgttcctgcattagtttgctgagaataatggcttctagctccatccatgtccctgcaaaggacatgatctcattcatttttgtggctgtacagcatttccatggtgtatatgtaccacatattccttattcaatctatcattgatgggcatttaggttgattccctgtctttgatattgtgaatagtgctgcaatgaacatatgtgtacatacatcttcatatagtataatttatattcctttgtgtacatactcagtaataggattgctgggtcaaatagtatttctgcctctaggtctttgaggaattgctccactgtcttccacaatgattgaactaatttacactcccaccaacagtgtgaaagcattcctttttgtctgcaacctcactagcatttgttgtttttttggctttttaataataaccattctgactagcatggtacctcattgaggttttgatttgcgtttctctaatgatcagtgatgctgagctttttttttcatatgttggttggccgcgtgtatgtcttcttttgagaagtgtctgttcatgtcctttgcccactttttttaatggggttgtttgtttatttcttgtaaatttgtgtaagtaccttgtagactctggatattagtcctttgttagatggatagattgcaaaattttctcccattctttaggttgtctgttcactctgatgacagtttcttttgctgtgaagatgctctttagtttaattagatcccatttgtcaatttttgtttttgttgcaattgcttttgttgatatcattataaaatctttgcccatgcctatatactgaatggtattgcctagactttcttctagggtttttatagttttgagttttacatttaagtcttttgtatgtcttgagttaatttttgtattctgtgtaaggaactggtttagtttcagttttctgcatatcgctagccagcactcccagcaccattgattaaatggggagtcctttccccattgcttatttttattaattttgtcaaatatcagatgggtgtaggtgtgcagtcttatttctgagttcttcattctgttccattgttctgtgtgtctgttcttgtacccgtaccatgctgttttggttacagtagccttgtaataatatagtttgaagccaggtagcatgatgcctccagctttgttcttttgcttaggattgtcttggctatttgggatctttttggttccatgtgaatatacaaatattttttctaattctgtgaagaatgtaaatggtagtttaatgggaaaagcattaaatctataaattactttgggtagtatgtccattttcacagtattgattcttcctatctacgagcatggaatgtttctccatttatttgtgtcctgtctgatttccttgagcagtggtttgtagttctccttgaagagttccttcatttccttgttagctgtattctttttgtagcagttttgaatgggagttcattcatgatttggctctctgcttgcctgttgtcagtgcataggaatgctagcaatttttgcacatagattttgtatcctgagactttgctgaagttgcttatcagtttaagaaacttttgggctgagatgaggaggtattctaaatataggatcatgtcatctttaaataaagataatctgacttcctctcttcctatctgaatactgtttattcctttctcttgcctaattgccctggccagaaccaataccatgttgaataagagtggtgagaaagggcatccttgccttgtactggtttttcaggagaatgctttcagcttttgcccattaagtgtgatattagctgtgggtttgttatatatggcttttattattttgatgtatgttccttcaatacctagtttactgagagttttaaacataaagggatgttgaattttattgaaggctttttctgtgtctgttgaggtaatcatgtggtttttgtctatagttctgttgatgtgaggaatcacagttattgatttgtgtacatttaactaaccttgtatcctggggatgaagccaacttgatcatggtggaaaagctttttgatgtgctgctggatttggtttgccagtattttattgaggatttttgcatcagcgttcatcaagtatattggcctgaagttttcatttttggttgtgtctctgccaggtttttgtatccggatgatgctgacctcatagaatgagttaggaagaagtcattcaattttttgagaatcattttcaattttttggaatagtttcagtagaagtggtggcagctcttctttgtacctctggtagaattcacctgtgaatctgtctagtcctgggctttttttggttggtagactatttattactgtctcaatttcaaactcattattattgatctattcagggattcagtttctttgtggttcagttttgggaggatatatgtgtccaggaatttgtctacctattctagattttctattttatgtgcgtagagatgtttatagtattctctgatggttgtctgtatttctgtggggtcagtggtgatatcatttcttatcatttctgattgtgtttatttgattcttctctcttttcttctttattagtatagctagtggtctatctattttgttaattgtctccaaaaaccagctcctggattcgtttattttttgaagggttttttgtgtttctatctccttcagttctgctttgatcttggttatttcttgtcttttccagctgtggggtttgtttgctcttgcttctctagttcttttagtcgagatgttaggttgttaacttgagatctttctagctttttgatgtgggcatttagtgctattaagttccctcttaacactgctttagctgcatcccagagattctggtacattgtttctttgttctcattagtttcaaagatcttgttgatgtctgcctaaatttcattgtttacccaagagtcattcaggagcaggttgttcaatttccatttgatggtgtggctttgagtgaatttcttgatcttgagttctaatttggttgtgctgctgtctaagagactgtttgttatgattttagttcttttgcatttgctgaggagtgttttacttctgattatgtgatcaattttaaagtgccatgtggtgatgaaaagaatgtatactctgttgtttgggggtggagagctctgtaggtatatatcaggtctgcttgatccagagctgagttcaggtcctgaatatctttgttagttttctgtctcaatgatctgtctaatattgtcagtgaggtattaaagtcttccactattattgtgtgggagtctaagtctctttttaggtctctaagcacttgctttatgaatctgggtgctcctgtattgggtgcatatatattttagtatagttagctgttcttgcttaattgaaccctttacaattatgtaatgcccttctttgtcttttgtgatctttttggtttaaagtctgttttgtcagaaactaggattgcaaccccttcttctctgatttctatttgcttggtaaattttcctccatccctttattttaagtctatgtgtgtctttgcacgtgagatgggtcttttgaagacagcatagtgatgggtcttggccatttatccagcttgcctttctgtgtcttttaattggggcattaagcccatttacatttaagattagtattgttatgggtgaatttgatcctatcatcatgatgctggctggtcattttgcagaattgtgtatgtggttgcttcatagtgtcactggtctgtgtatttcagtgtggttttttagtggctggtaacaattttttctttcaattttcagtgattctttcaggagctcttacaaggcagtcctgagggtgacaaattccctcaggatttgcttgtctgtaaaggatcttatttctctttcacttatgaagcttagtttcaccagatatgaagttctaggctggaaattattttcttcaagaacgttgaatattggcccccaatctcttctggcttatagggtttccactgagaagtccactgttagtctgatggcttttcctttgtaggtgatctggactttctctctggctgcccttaacattttttctttcatttcgattttggagaatctgaggattatgtgtcctggggttgatcttctcatggagtatcctactggagttctctgaatttcctgaatttaaatgttggcctgtcttgctaggtttgggaagttctcctggatgatatcctgaaatatgttttccaactttattccattctccccatctctttgaggtaccccaatcagtcgtaggttctgtctctttacataatcccatatttcttggaggtttcgtttgctcttttttattcttttatctctattcttttctgcctgtcttatttcagaaagatagtcttcaagctctgagattctttcccctacttgtctccatttttctcaggaggtattttaacaaaatttaaagggatgtaccacactgtttacaattactgtgtatatttgtgtttacgtgtgcacgtgtgtgtacgatgaacccaaggaaagcatattctaaaataaggaccaataatattattttctatgatttcttcttagtactgaacccaataaaggaatatcaagaatgtttcagacagtagggtaagatagagataaatcctacaattgccacttataatctgggtaactttgggaaaattacctttctttgaacttattttattaatttttagaatgagaataataaaaataccctcctcataggactgtggtgaagattaagagaattaattaatataaaacagcatggagccaagcatatggtaagaccttaaggaattttatttcattaattataaaagacacatttctcccctacattttaacatctccgtagagaaaatatgtcttacaatttatgttcttatagttgatgaagcaagtattcttatttaaatatgatttataatcgaaacatagttttttgttttaaaatgttagaaatcaacactatgaactcagataccaattctctcagtggggatagtttgcagtgaaggaaataaaatggagaaatttgcaaattaggacaaaattaatatgtgttctctttgagtttattcatatttattccacaaacatttgaatggataaccatgtgccaaattctgtgtaggacaaatttcacaagatgaataaaacgtaatatttgtcttcaaagatctaacacatgttcatggaagacaacagaaccgtataagtacagcatcagttataagtacctaagctaattgtttacatagaagaaagacctaattcataggagaggagagggtggggaaagacaaaatgaaagatgtgatttctaaattaagtctcaacagactggtaaagtgagccaggtaaaaggtgaagggaagtaagctctagaaggaggtaatacaaaaggacttgggagaagaagagagaagaatctttcttgtccaagaaactacatgatatttaatttggatgaaatatttgcagaaggagtaaaaaatctcagctagaagttaagaagggtcagctcacggaggaccttgcctagttatgctgatgagcttgaactttagcaggagttaaatgaaaatactctgaaacagtttaaaatggagggggtgatatactcacaattttatttccaaactgttgttcagagtgaattaaagtggataggatcaaagacaaagagggcagttaggcgcttattgtgatcattattaatagtggtattggagatgtagtgaaatgggcgattatgaaagtgatagaatctataggacttgatgattaatggaatgtgaaatagagagaagttaagttgtaataaccacatctcagttcaaatgataaacaaatgccatgcagatctagagcgggggccatttgcctgagccattgtgcctaacacagtgctgagtccacaataaaccaatgctaaacagttgtacattgacatatcatcgattcctctggaaattctttgagtacttcacacacagatgtccatattgaattaatacataattatcaagagaaaaaatatccctgagtcaacattctagaaatgttcaagtgtctagattggattttctcattgtccttttccataacaacacagtgacttggaacataacatgacactaagaaatagaagaataaaaaggatcttgaagcaattcccttttatcttgctttattcttaacagcatttctctggtctaattcttttatggttccagggagaattacatttcaaattccataattgcacaggagaattggagtcttgtaaaaatttagagtacttcattcaaaggcaatttttattatcaactgaacctatgctgtgatgcagccaaagaaattgtttagagcatcattaaaataacctttttaatatgactgctttctcttgaaaaaatgtagcaccctcttatttaatattaccatattacaatggactatatatttgttgaaagtcttatagtatggtatttagtatattgaaccagcacaaaatatacatgaactttatcagttttcattttccctttacaaaccaagaacaatattaaatgacattttatgacatttgataggtatttaaaatttgttattgaggttcttcagtgagccataaaatacaagtgtaacagtatggctgtgctttcattatgagaaatgcaagcaggaagcatttaaatcagcaccattttccatcaatgtcttgctcctgattctctgccaagttcattatctcttctgtccctaaatttgtccatatgaaaaattaggagaaaaaagaataaattaatacctgcctctaaaatgatctgaaatccaggtatggaaaatcttatacaagtttaaaagactggtttattcactactgtcctcatttgtttgaacacactacaatgttctgtgggatagtagctgagagacaagcaatagtccttttcacaccttccatccgtaaagacaattcttttatttgcagctgaagctattatatccagagcctatggctgtttggctcttttaacaatggaaattttaaaagagaaacagcaggtaaaatgtgaaaatgtcctctgggatattattttattactacatgtcccttatcatttagcaaactagatgcaatataaaaaattaagtcagtttgtttggtgcctggttggcaaaaaatcaaataacagttactaaagaaataatggtgagctaacctaaactctgcgtgtgtgtgtgcgcgcgtgccataaagccaaggtggagaggtgaatgaaaaagtcattagaggagaggcaaaagccatatcgcttgaaaaaagcaccatggtatcatggtcgaagaatgggctttagacgctggcaagcttgggtttcaattatggcattttgcagtgtgctatttatttccgagcattaatttctacaatgaaaaaatacataattaatatctcataggatttgaaggatcaagtgagatgactgaaataaagtatgaatccagatgtctgtcatattaattctctcttttaatcatgggagctattgacaatgcaaaaggtactcagtatagcactagaatgatagtgtacctcccgagataatgtgtaaggtccttcactaacacctttttcataggaatattgttgagctgccttcacacagatagaatatctgggttacaaccactttgcagaaaagttaccagatatagctttttgaaattttctgcctgggttaaaattacagtcttgtagtaactctttggtgcatattagtaactgctgaactgtgtggtgttgagccaatcacattgatgggaaaggaaatttaatgcatcagacaagggaaagttaccacggttagttagtagacatagaatgctctaagttagtaaattcatggtaagttatgcaatagaagagatcataaataactaaataacagggaaactgcaaaaagactagcagaagttggctgggcacagtggctcatgtctgtaatcccagcactttgggaggccgaggagggtggatcatgaggtcagcaattcaagaacagcctgtccaacatgatgaaaccccgtctctaccaaaaatataataaattagccaggcatggtggcaggcacttgtaatcccagctacttgagaggctaaggcaggagaattgcttgaacccaggaggcagaggttgcagtgagctgagatcgcgcaactgcactccagcctaggcaacagagtgagactctgtctcaaaaaaaaaaaaaaaaaaagactagcagaagcacatcagttattattattctgtaggaggttcaaccagaatctatctctttgctctctattatctataagtcaccttctagatcttacaacaggggcagaagtacacctctctgaaatatccttcttacaactgtaacttatagatttggtttggtgtctacattgccaacattacttaaatgtttacaattccactgtgacctgttgtcactattacatttcagagatgtataaaagaaatgtcctcttctatgcaggaatatttgtatttcatgttggaattaaaacccaggcatgttttagtgtacagataggtacccttctaaaatattaaatcattaccccacagcatgaattaacctttgtgcctctgctcttataacatcattaacataatcatgataggatataaaacactcatagttaccctcacccctgctcttggctctctctgagggaagccagcttccatatcataaaaagaggcccataaggaaaaaaaatggaggcctcttgcctggagctaggagaattagctgtctgggaagtggatgtttcagtgtcagtaaagccttcagctgactgctgccccatctgccatcttgactgcaacctcatgagagaccacgagccagaacaatcccagccaagactccccagggtgcctcacctcagaaattgtgtgagataaatttgtcatttttagctattaacttttaacattatctgttatgcagcaataaataatcaatacaggagggtcaaggggtcaagtgtttcttgttgatacccagaacacgtgagatcagggagtaagtaacagaccttctagaacaagggttgattaaatctaagtcaggagaacaaggctcaatcagtcaagggatcttggaaagcaagtgaaagtttggagagttgagaacaaggcccttagaagtgactcatggtgtgaataaattccagagagcaagagcaactgcctgcctggcttcttgcattttcacagcttgcatttggaaaggggggcttggtgcattcaaatgaataaaaacaagatggtcataacatattatgaatactgtctgtatagtcaggcacctttcccaaagtaataatttgaaataaagattccattggtcagtaacaggcaattcccatttttgagtgctttcgtgatgtgttcaatattcccagttattacttcccaggcattatgctttatagaaaagtacctattttttaatgactggataagctgggccttacaatccacttcaaacctgttgttctatttgtccatgagtacacaggctgctctaggcaggaggacatgaaactacaaaccattaaatggtgataatctaaaaaacgttaagtaattgtcttgcagacgtaaactcagaataacatgctatatacatcttggaggtaccatgaaggcatggcccaagctgtatatatgtatgcgtttgtataaatatacatatgcatgcaatcatatatacatatgcgtgtgtgtgtgtgtgtgttgagagaaagagaaaggagagatacctagcacaagaacatattttgataatttaattcacagacataaaaaggaaatgtgggcacttaagagactttcacttgaacgatatcgctccacagtgaggcctttggggaaatctctgcacacactgcaaacactgttatggtagaaggaagctttcttctccctgttactattagagagtttgtcacctatctttgaggctcttggcccatatctaagtatgaggaaagaaaccttagcagtctttgataggcagaggataacattgtaaaccctagagctgtgttttaagaggaagttagaacaccagtaagaggaaggtttacatgttaagacaaacagatgaaccagctgagtaaatgtgggacttgaaggtttcccaatactctccagctccaagaagaatggacttaattaactgagagctgagaccacacagtgtgggaagagcagaggaaccagaaggggcaaggtcaagggagtgaatggaaaggagagatgctgctggactctgttgaacaaatgggagagtatgtgtctatttttgtaatctattagttacgatactcttagatacaacaaggaaagtcaaattcgggtttgttgaaagacataggaactttactggctaccgtgaaaggagagccccgtggtagatggacattaaggctgtactgattctgtggctcaaaagtatcactaagagccatattcattttcgtgtctttgtcctgctcctgcctgctatggaaccagcttaatcctaaagcctggatccccatcagagtcacagaatacaaagcatttgtatgttgtatggaggaggagtaactgttcaaataaaaactggggaagtctccaggcaggggggaaagcaactgtttttgttggagaatcaatcacctccccacaccaccctccaccttctcctgcccctgtcccaatggctgtatcatcctatggagataccatctgcatatccaatagacagagtaaaacaaacaaactcctaggtgtagattacttcccacctttccaggtattaaaggtattttatagaaatatgtgtgtatgtatattttcctgaaagagagtaaaaatatttgtcaggaattgaaagaaatcggtgatcctaaaatgtcaaaaatcacaaaattttaggtaaagtttcaagataaattggttcttacttctcttctattgtttccccaatttacatccacatcacaaacacaagaacaactcaaaccttttccttttgtcatcctacaccatgtcatgcctcgggttatttgaccacgtcacttcctctgcctcttctgcctggtaagccttaactctgcctttatgacggaattcatgtacagcctcttcactggagcttttctttattgctttctctttgtgaacagcagatccagctcttttgtaccataaacgtcccctaacaataagcacatactccacaacattggtactttttgtttgcctgtcctactccctaatgagactgtgaggaatttacacacaggatttgtgcctttcctattcgtcttttggtgagctgtgctggcttatgaagctgttgttcagtgaacacacaaccattgataggtgtgattttcagcaaagtgacaatagagaacgtgtaggagctttgtgatggtgtactagtatcattgttattattattattattcaatttaagagaggtttttctccttggttaggacctgaaaacctacagggcaatatgataaaaataaatctctagataaatgatgtgatcttctttaatcttggggattcacacatcatggccctgaagcaagctagtgaatgtaattcttaagtgctaacatttgtggagtgctttctatatgccaggtgccatgcttaatgctccacattcatcattccatttgatctttacaaaaatctcaggagatgggttccattattattggtcccattttatagatgagaatgctaggatttgcagagagtatgtacatcatccatgtcacactatctgttcattagatgaggcaggatttgaattcagggccctctagctataattaagcccttcagaccagttaaagattatgctttaaggtgctctgtgtgcaaggcaaagcgctatataatttattataaaatattctttaactcttaaccataatcttgcaaggtagaaattattgctctcattttaaaggtggggaaactgagttttaaagaagataactacatttgcctaaaaagtataatcagtaatgttagtgccaccctttgacagaagtttatttaattcctgaattcatgtacctttcaatcgaaacccaggaaaaacgagtgccaactacatccaaggaattgttgatgggaatggggggtgggcagtccaggaaagctgaggctgttatgagaaaatgtctctgccttgtggggacttataacactgtcaagatggtaaaatctggtattataaaacaggaatagcatttgaggtcatctatgaaaataatgtgaaaagctagctacaaatgaaaaatttaaataacaaatcagcgcaagcctagagagatacctctggatagaaggtgattaattctctagtaaattagatgaataattattgatatagccactagaggaagggggatttgggctccaaatttactcactgtctttgaagaagctggtcctctgagcatctgtaagttacctcactgcagtgtaatgtgattgtcaatgtatttatagatcaaccacattagactgtaagttacatgagggaaggtggggccatgtattgtatttttgttctcagaatttgacctaatttgttgtacttagtaggtattcagtacaaatatattgcatgagtctaccatcacttcaaccaggggggcatggtcagaagaaccatcatacaggaagcaagttttgaagtgaggaaattttttttttttgacagtttaagatggtatgggaagtccctttaggtggatgaaatggtgtgagccacttgatgttgttgggagagcatcacagtgggcgatctctattcctagcatctgcctggtccactggtagtgggtggccattgctctctggaaatggacctgcagagagggcacaggcaccaggagatatcagagtggcattatataatttaagatatttagccttgatcttgaaagatcacatgctgccctgttacctcgtatacttggctccttctccctggtccatgaggccatttgaagacacttaaaatgcctatttcattcctcactgcacctatggctttatattgccttgtcatattcaacgctgatgctgtggtctgcacacgtataagtcacaaggatgccttctggcatttatcaggcacaggtttcttggatccatcctggattctgcctctttcctaagaacagagtatggctctgaaatggatgctaacctcagaccaaccagctgagtggatggaaaggagccaaaggaaaaccccagaagatagtccagaaagaagatggaggctcttatgtctgtgttgttcacatcaaaatcttcactttctttgtaccttgaacaatttggagtccactttatcttgaacctacatccaaatacctctgtattagggtgagcagggtgggaagaaggggaggggatatacattggcagagagatgatcttctcctggaggttgtagtgtgtcaccaagaaagtcattgcattgccggtgagattcaaataattaaagtatatgtgaaatcactttcaaaaaattctatatggaaagttatatgttgtaattaaatggttttattgacatagagttttacattaacgaagcattctttttcaaaaaaaataatatatctaaatctttttctcagttaagaactatgcttcttgttctggggaaaacaaaccacttttatttacaggagaaacaaatatactttttaaaaatccagaaaattgtaaataggctagcagagctgctaaacacgcataagatcacaattgtgattttacaatacatcttaataaaaagagtaaattacttttcattttcacagacataagtttgtttttaggctttcccaagtggattgatacacttgtttgaatgtgatttccatttacctttatattaaaataaatggaagtgaaaaggtcaagtttattcagaaaattgttagctatccttgggaaaaactaattcagcatgtgtgattttaatcaattttcattcattgttaaagttcacacaaagtttagcttgatgtccataggaaatggaagtggtgactggtatatcaggcacgataagtataccaaatctgaagtcctctagatagtatggttaataaagcatatttgtctggttccataaaatagaaatgttgaaactagaagagctgctgggttaataggagcattttcaattctcaatcttcattattctcaatgccaagagggaaaatttgactcaaacacactgtttgggctgtaaatcagagtagttacagggtgacttgggaccagctatgaaagaaagaacccagaagtgggtgatatgaggaaatatatgccccaaagaagggatttgggcctttttcctactgcctcccacagagccgggctgtaccacatgcttttccaaattttcatttagctccctttatgtgctagggatcatcagggcaacagggcaaggctggatgatgttatggtgttataaaggttaggaataaggcaatgctcagaatgatgtatttcagaaaggactacatgcccataaatgcaatctagataaagatgggattaggcactgaagctgtaattgtgctggtgatagacatgccagcaatagcagtggtgttggtgatagacaatcaaagatggaaaggatccgtgtggcctgaaataagatagattggggagaaggaaggtcttagtctgatagtgaagtaaggagagggattgaacaggctgattgaatgatcattccaggcctcagtagggatgcagagatagggacgctatgtgatagatgtgtgtagatactagcctattctgctacagccagtaggaatgttatgttttgacatatttgattgacagatgcaagttgtaccagactacacaaaccaaatagttaatagttatctcaaaagaggatgttgacagatttcaaccatttgcagggtcattatggcccaacctttggaaaattaccattggtatccctcaataatattattttgcaatttggtttttaaacactctctctcccttttaggtaagtgtgtacaggtgcatatgatagatttcaaatgtgaagtatacctacagggtgagaaatgtaatggacaaaatggggggttatggactgaattgtatcccctgaataatttatatgttgaagctctaacctctgatatgattgaatttggagatagggtctttaaggaggtaattaaggttaaatgaggctatagtggtggaatcctaactctatagactggtgtccttataagaaaaggaagagagagtgcacatctataggaaagactatctgaggacacagtgagaaggtagccatctacaagccaatgagggagcccctccccaaaaccaaccctgccaatgccttgctcttggacttccagcctccagaatcttgaaaaatgtaatttatgctgtttaagtcacccagtatatggtattatgttatggtagcctgagcagactagaacaaggggccatggtcaaatagtaattctacaatggaagaaaattgaaagccacattgagctggacctcttcatagacccaactggagagccatgactttgtcaagagaatggagaaaattcttatcctaatatgacataatcttttagcccagtaccttttaaatagccttgttatactggatgtactataaatttatcttaaatttatcacttttgggggaggatgttctaaactacattttttcataagtttatgagaacaaaaggagtagaatatgtagataagtatatattcataagatgtatattatgtatatatacataagaatatgtatgtgtatatatttgttccatcttaacttttccataaagaatttataactcacatctgtcttaatttactttccttgatcaccgtgtctattagttgccaaaaggaaatggaaaacaccaatatatcttgttatgtttatactgagaatattctgtcaaattggttggaaaaaaactagaaaatacaaagtcctacagtatcaaggatttaataactattgaatgtataaatgataaaaataaaaagagaccatgaggacaaaaaagggagaggagagtataccagctaggatgctatcagtggcaagtaataaaatatccagtataagcagacttaaataatataaggctatattgccctaattaccaagaagattgaaactatgcttcaggtgtgggttgatcatggtggcaattccttatctatattatttgcccaggtccatgtatcagcttcatcctaaggctggcttctctcatggtagcaaagtagctctatttgttccaagggttcatatgaatattccacactgacaggaggagagagtgtcattgtttagtaggtttatggagttaactatgctgcccccatgggccatttttctactttatgcagactagccttctaaagaacctagcatatttgaggagtaacttaaattacagtgcaagttctaagtcagtgaaagagctgcctggccatatcttttgattccaaagttctgtaggacagaaccagcacattttacaaattggtttagaattatacaagcctgtctggtgtattatggggagaggtgtccctgatggggcctaactggaaagagagacaataagatcttgtattggcacccaagttgctgaaataaatgaccaaaaccttgattgtttaaaataacagtaatttacgctttcacagttctggaagccagaattcaaaaataaaggtgtgaacagggttggtttcttctgaagactctaaaggagaatatattccatgcctctatcttagcttatgggtgattttggtaacacttggcattttttgacttgcagacacatccctgcaatttctgccttcatcttcacatggcctttccctctaggtctctgtcttcttttatatctcttataagaacatttcactggatttaaagcccattctaaatctagaaccacatcaccttgtgatcgttaacctaattatatctgcaaagaccctattgcaaagtaatctcacattcacaggtattgaggggttaggaattggatctatcttctagtatccactgttcaacccactacagatctcttggagaaaattagcatgagtgaaggtccaggcagtggaggagcagagtttctaggcacatcttaattctggcaaaaagaagagtgtcatttaaagcagcattctcccaaggagggggatgtgaaaatatgttggaacttctctttataattttcttcatctaaggaaataagaaataaataatttttctaatattgggcatatagatggataccatggccctccctgggtctgtgggtcatgcaggtacatgtcaggtacaagaggcatcctgactttgggagggggatgccacacagatgtggggctgaccgtcacacgctttttcatccttttgttttctgtgtttcaggatccattgctgtttacatgggcccattaaatggagttatgactattttctagtttatgtaagttgaccttcacaagacgaacaattacctttaaatattgtttctgactaaagacaatactaagaatgcattagtaatagagaaaaaataggaagagctgacacttctacacttaagtggactcttatcagcccaagtaggaggtaaaattatggtaatctaatcagatataagaagcatttagataaccaaatttcaaattattagacagctaatatttgtattatgaatttatatccactgttgttagttgttaccatcactaaagtccatgatatgtatcgagacagtagttattaaaagtacatatttggggaatgtgaacttaaacatattttattaatggagcaaaatttttaaactttggaggccattggtttcatggaaataaccgtgcatcacttggggctcaatagctttacttgaaaatcccactaaaaagtgagtcatgagagtcttgctagccctttgggtgacaagagaacagaaccataggttagcaatgcaaggtaggtcagaaattaggtgcccagcttaatttctgttctgcttagctgctgtctgttctgctatccaatgccaatcaagtagagcaatggccagagtagtggagcgacagattctacttatatgtgataattcaccatctccagcctcttaagcagaattctatgcaccagtgtcagttatggaaaggggaacactgtatacaaatttccaatcccagggggactctaaaacctcaccagtttctacaaaggtttctaagtgtggaaggaggtttttcacaaacccagctgccagaattctacaagagttcttgactctggcagggactcaaaggagacacggctgcttcaggggtcatacctctactacttgcattcttagctccagtttggtaagaaagaataatgataggagtcaggcaaagcaactttattattcaaggataggcagctaaaacaaacaaacctagaatccatgctgagtcagttccccgagtctcaggaaagttgcccagggcaggtggagccttatctgttcatgcccacttcatactgcagctgagggacaccaaaagcaatccactatgggttttacaccctggttgcccctgggttgctgagcacaagcattgcaggatatcctgttccaggagggatgacaaagcctgggctattctaggtggtttctccttatgtcaggacactgtatcctcagcacatgctacagttttcccaaaaactacagcagaagggggaagaactgggtcagccaaggctctctggggccctgtcttcctgcacacattcttcccctgttcccaccaccggcacttactaattgacactatagacagaaaactgagcaccttggtctggaaggagacagtgctccagaggaatgttttgtagtttggttgcaactgtggctcaggtgtacatcactgtggtaaaaaaaaggaggaaagaaaagcaagaaaacagaaaaggaagaacgtgaagctaatgttgggtgtcagaaaagtcctaacagcattcctttaactcgtttacttttgtttgtttttgttttttgttttttgttttttttgagatggagtctcactctgttgcccaggctagagtacagtggcacaatcttggctcattgcaacctctgactcctgggttcaagcgattctccggcctcagccttctgaacagctgggactacaggcacactccaccttacccagctaattttgtattttttagtagagacagtgtttcactatgtaaaccaggctgatctcgaactcctggcctcaagggacccacccgcctctgcctcccaaagtgctgggatttcaggcttgagccacagcgcccagccccattgcttactctttcactgctctacctcttatcacaagaagctggcccttcaagccaagccaattcccaggctcctatgtcagctgcttgcatttgaccaaagggaggcattggcaggagattggagggaagaaagacaggaggagcctgggtactttcttcccctctctgagtcttaggtggcagctacagtgctacatctcttccgtgatctacctattgacatccaggttcattttgatttcattggcctctttcctctctctctccagcctaggtgtggaagcagccttctgctatttctgatctctaagtgacttccctgactcatttttggcttgtcaacttcttaattccctgtgtaaaaaatgcccttaaatttcctttatttcaatacaataactaatttctgttttcctggttggacaccaacatatcctttaaggtagaagtagataggtgatcatcattcaaattttatattttattacttaattgcatggtgttttccatttgcctatgattttattttttagctaagatatgttctataccttttcccctttgccttatgaaactgccaagaactaatttcatttttgatgtcctgaagggatattattagaaaagggatggagctgattgataaagcaaaaatacaaatttataattggtgaattgcagatcgatctatatgatgggaatacgttctaataagatttttttctctcatttcctccttgcagatggatccctgaaagcctattatctttaatataaaattcttatttattatcttttaaaggtttggaaggatgagagctttaaggggaaattgagtagagaatgagattaggaaaggatttcatgcagagaaagaaagatatataatgcaaactatgctatggtctttgcatatgcaaacaaagcatctgacctactttcaggaggccacactcttttgagcttttccagtaattcattctctcttcccaccaactctaccctgttagaatgcaaatagttaggactgtaatgtggggcatggtatagaatagatgttgacaaactactaaggcctgtgggccaaatctagctcacagtctgtttttgtaaataaagtttcattagcacatacctatgcttaattcaagtgcttattttctacagcttcttacatgccacaaaggcggatttgagtagttgcaatagagacaatgaacctgcaatgttgaaggtatttgctatgtagatctttatgaaaaactttgctaatccctgctatacaataagttgcttgcttttaagaggattactatgatctttttgcttttcaggtgaaacatttctggagcacctactgtgtgctaagtactggctagatgctttatagaataaaagcacaggccgggcatagtggctcatgcctgtaatcccagcaatctgggaggccaaggtgggtggatcacttgaggtcaggaatttgagaccagcctggccaacatggcaaaaccccacctctactaaaaatacaaaaattagctgggtgtggtagcacatgcctgtagtcccagctacttgggaggctgagacaggagaatcccatgaacccaggagacggaggttgcagacagttgagatcatgacactgcactccagcctgggcaacagagcaagactccgtctaaaaaaataaaaaaaattaaaagcacagatatgaaatgcaattaaatttttcatgtagtaggataagaatgacacctgcaaatttaggttagacaagggaataacatggatgcttagaagatacagacaagggttgttccagatgacaaagaaactgctttcgactaagatagagaacacaacagcaggggttaggattttactttcttttcaaaccaggaaagacaagagaatgccatcctcctgtgtgtatggagaaaacaaaagctgaacacagttatttgtgctttaagttcagcctgttggacttcatacactttcaaggaaagcagggcaagaaaaaaaaagattaaggtcaggaaaaaggcagtttttggatgatcatcaattcatttacccatttacccatcaacgtttgagtgccctttcttccaggcatggtatgacatgctgggcatagacaataattgtagcagaggaggttcctgcccccagaaaacttttattctggtgggtggcacagggtgaatagatataatacatacttccagctcagcagactaacaaggatttttatctcagaagaagatttaggaggatctttaaataaaagtgcaaggagaatgtgttgaagattcaggggagtggagagtttgagaaaatgggttcaggatccagctgcctgggttacaatgggtggccctttagggtgtacagctcccctttttgggaagttactgagtacctctgtgtttcaggttcctcatctttaaactgggatgataatagaatgtactcataagactgttgtaagcattaaatgaggccatgtctgcaaaatgcttaaagtagtcagtgcttggcacatagtaggagctatgatgtttactaatagaagaaccaacctgaccctttgtttttactctgagactgtccacgttttaattattttttttttgtgatagttccaataggataagtgaacaagtctaagaagagagaactgttttgttcttttttatattttaaatgaaagtacttgagggtcataaaatgaagctagcaagaagttataatttaattagcatgccattgtttatctacttcatctggaataattaacttcatgtatacaagactgctgcttccaaagatctcaaaatattttctttgaaaaatgcaattttccactgaaatatgtagaatagaaagtcaaattataataattatcatcatcaaatatttatcaaatggttatgatataccagtcacagaaagtggtcttacacattctggctgggcacggtggctcacaactgtaatcccagcactatgggaggccaaggtgggcggatcacctgaggtcaggagttcgataacagcctagccaacatggtgaaaccctgtctctactaaaactacaaaaatcagctgggcgtgatggtgcatgcctgtaatcccagctactcgggaggccaaggcatgagaattgcttgaactcaggagatggaggttgcagtgagccgagatcatgccactgcactccagcctgggcgacacagtgagactgtgtctcaaaaaaataaaataaaataaagtagtcttatatattcattaactcttttccttaattttggaaatccataaagctgatattttatccccatttttcaaatgagaaagctcagatgggcaaatagctcagattctattcctaaatcacactagacatgaggtaggactccttcccagggctacctgactccaaagtgtgtggtccttcctctttcttatgtgatatggtctcaaggacacattgaaagttgacatttagaacacctacttcatcttctttcaaaaagaaagcattagtaggcaaaattgtaaaatgtatccatcattttatcaatcataaaagcattacatatttattacagaaattttgaaaagtttagaatactatgaaatagatatacatcagccattaccctagccactagaaatatccattttaattattttatatattttcaaaatttctttttatacaaacacatacacttctaaatggtttcctactacattatatggtaagtcagacttcaaatttaacatgccatttagagttgtataatattatttcaaagtctacatagaatatttgtatggctgtagtacaataacacttaagcagataccttgagtgcttctaagtttttacaattataaataattttgtaaccaaattctttttttttttttttttgagttttgctcttgttacccaggctggagtgcaatggtgtgatctcagctcactgcaacctctgcctcctgggttcaagcgattctcctgcctcagcctcctgagtagctgggattaccggtgtccaccaccacgcctggctaattttttgtatttttagtagagatggggtttcaccaggttggtcaggctggtttcaaacttctgacctcaggttatccaaccccttcagcttcccaaagtgctgggattacaggcgtgagccaccgtaccccgcctaattttgtaataaaattctgacgcagtctttcagtcttttattatttccttaaaataaaatgactgggttaaagggtaaaattattttagaattgctgatatgtatagacagactgttctccagaaagaatacaactaagtcaatgtcaacttagctaaagccctatcggaaaataaaaacatcgatatactttcctcacttaaccattaggcaccttactaattttcaggttatatttggcactgaactgaacaatacaaaaatactttgagcagtatgtcactcaccttctaactttcaatgatatatgatccaagataaaatcattcaatctatgattcccacactcaagaaatgtttgcttgcccatcattttcaaaaagaaaaataataaggatgggtgctaaaagtacaaatttggctgggcgcagtggctcatgcctgtaatcccaacccttagggaggcagaggtgggcggatcacctgaggagtttgagaccagcctggccaacatggtgaacccttgtctctactaataatacaaaaatagccgggcgtggtagcacatgcctgtaatcccaggtcctcgggaagctgaggtatgagaatctcttgaactcaggaggcggaggttgcagtgagccgagatcgcaccattgcactccagcctgggctgcagagagaatccgtctcaaaaaaaaaaaagaaaaaaataaaataataaataaataataaaagtaaaaattttagactttgcatgtgttcctgagtggatttgtgtttgtgtgtgtgtgtgtgtgtgtgtgtgtgtgtgtgtttgcgcgtgcgtgcgctcatgagtgtgtctgtgtgtgttggggaaggttgaggtgtagtgatgtggagtattctcgggagtttcctaaagtcatgaaatctatgaacatgacaagcatgctgggtataaaggcatctccagcaacatagtggcagccaaagttttttataggaaaaataatctgcttcccaaaaagtagaaattaatttcaaagcaacattttataattctacactttattaaattaatacttataccttggaaatagataatcaagttctgaaccatgtagcactgaaacactagtgagagctgatgatgacagaggagggcctttgccttctgtgacaacaaaagcaggaacaaagagaagcagacaaaagagtgagtgattcagtcacactgatggctctaaacggagaaaagcctaaacaacactcttaggaaggaaatgaggatgagctttcttggcccaaaaacctggtctggctccttgaaagttcttgaaccaagttctagtttctgaaaagctcatggcatatttagggtttggttatttttctgagactatttgtaaggttctctctgggtttctttgagacctagattatgttaaatctccattacttgacacaatccgagtaagtctatgattgttttttttgttataaaaataaactaatacagcaaaatgatttctgagggttctgaagtatcagacttttccacatcatgtgatattagatcattaggaagactggacaaataaacaaagaaagaaacaaaagaacagccactgagaatgaaaaagagaaaaacattgatcctgtttcataatggggttgctgtctccctagaaagacaaaagtcgcttgaaagaatccttttcaagttaaaatcatgagtgtattaatattatgtcacatttcctagtctctacctatctgagctcctgagaaccatatagagatttgacagcagaaacaaaaaattacaggaccataaatctttctgttatctgtgagcaggaaacaggctctatgaaaggatgacaagaggccctgatcccacttgaaattaagacagtaattaagcaccaaaataaaggtaacaattgagaagaaaatgtcctctagtggaaaattctcattaattcaatttgtattgatataaataatgttcctcaactttcttttgaatgatatatagtcttttaatggccaggttgtcagtggaaggaaaactaatactttattcgttgaagaggttcaaataagcaaggatcatcctccatggttgaaaatgaaaaaaaatcaatattgatgtgtttaagacactcttttccacagttgttgaaataactttgaatgtctcataaaagacaaatattttattctaggaaaaaattctaagaccttttactacaaataatctgaaaaatattaagcctaggtaccactatctgcctactgaacctccctgaaataaaaaaaaagtacatgttgaaaatgaaaatttattattagaataaagctactgttaatcagaatgcagctaatcagaatttttagttaatttaagaaattagtttgttccagtacaaaaaagctgggtacacagtcacacagagacacacacatccagacatcacctcccacacacaaaaagatatggctggtatattgattaatggatgactattaatatataactaaatatttatatgtatcactaaataatatacaaaatgaatcaaagtactttgtcttatgatatgatcaaggacataataaatatgagcgagtgagcaaaattaaaaaacaactcaagatgctaccagattaccaaataagtggtgtcaatacctggtttttatactggacttgaaacacatcaaaaatagtgtgctaatattagcaaaatttctaaaggaaatgattgtcttttttttaaaaaaaaaacaaacgcacttaagacttttagaaaatcagtcaatcagctggcctcccaaatatttaggaaaataaatttaaagtgaagacatgaatgctaggaaatataagaaagaaaatttaaaaggaaaaaataagaaattttaaaaaatgaaataaattagtattacagctagcctgcttaaaattgcataccgaaatgtttgatataaagactaagtttttggtcatgtatgacttggtgaaagtttaatgcctttaatataaacagcaaacactattccatgtgaagacgtgaactaaaacacatcctgtgtcaaccacatattgggttgtctctttcttagtcttccacatctaaacccgaaaacaataatgtaataccctatagcatctttttttatccaatagaactttatccatataccaaactgtacacaggaaactgggcttcgtaaaatactttatgtaggacaagaaggaaagtagaccacaactcagttatatagcagtttcacctaattgggcagtccttctttgggtgttctaagcaacatcttgctgtatacaaacaaaactacaatcttgattatgttcttaactggttgatcttccttgttcaaaagataaagtagataatttgtaagatctctaaaaaccatagtattttagaagtgtaaggttgatcttccctgttcaaaagagaatgggttaaagtggatagtttataaagtctctaaaaatcatagtattttagaagtgtaaggatccactatttgaggaagggtaaccagttattagcatcattaactccattttatacttgacccaatatattgaagacagttgcctacaatggcacaactatcacatttcttcaaatataagacgtacacagctttaaaacaaagaaacaaaactgccacttgaggagtggagaagactcgttacagagccagtgctgcctgtgcctttggaagtaagccttgcacagagggttcattcaatcatcaacgcagttaattttcctggcagaaccacagttatatcttaacttaaaattgtaatggaaatgtacattcccgttaagatttcttcaaaaacttccattaggagacgactttgcaataaaaggtgactgcatatggagaagacagcatgccacatgccagggaaaacaaaggccatagaaagtgtcagatccttcagagtaggtctgcgaattctcagagactgttttgtgattgatctatgtgtcacaaaagactctcacttagacacagagcatctacttgtcaaaagcattttgctgctataccagaaaagctatttaacttaatttttagaaatatatcattaaatcaaagaaagacaaatgaaagtaaaaattttaccaactaggaaatgaagaggaaaccctgaaattgttcaatacaacattacttttaaagcagttgaaaaggtaaagatttataatttaggagactcaaaaacagattggctccgtaaacctttaaaaataatgtataaggtttgctagattatattcttggagaatttttagatacttgatgttgctacagaaaataaaaatagtagccatgtaatgaatgccataatcagctaaagaaacacccagtacctccccaccagtacctcccttctactgatgctattattaaattgatggtgagttttacataaaatagtaatttaggattagagaaaacagtacttgatgataaagctggaactagaaattcagggcttcaaatttcacatccagtgaactgctaaagacttttataactactctgtatttacaaagaatcttatatacatatctcacacttctgatgagacatattgtaagaaactattgctattttttaacaaacttttgatatttgcttagttgtatttattactattctgatacatagaactagaattggagaaattatctctttctatgtttctggaaaggcttgtaccatctcagaatagtttgttatctaaaataataacaaaaaaaaaacagggactccatagttcaacataaaaatgaaagttagtggttttcaaatattacatctctctataatagctatcattaccttttgatttccctttgtcatttgtgtaatatatatctccagtcctatagccttcaatatgatagcaactagccatatgtggctgtataaatttaaataattgaaagtaaaaatttaattctagctgaggcaggagaatcgcttgatcctgggaggcggaggttgcagtgagctgagatcaccccactgcactccagcctgggcgagagtgagagactctgtttgaaaaaaaaaaaaaaaaaaaaaaaaattagttcctcagttgtgctagctgcactttcagtccctagtagtcacatgtggctagaggctattgtattggatagatatagattgtttccatcatcacagatagttagttctatggtactcttttatgacataagaaccaatgtttttggtcacaggtaacttggtaagagaagtttgacacctttagtagcagtaaacagtgccacagtttcgttaaacaaatctgttcaaggattcttggatgctatttaaaatgaatgttaaggaaaatgaccagcctcaggttgtaatcagtagatgtagatacatgtatgctaaatttgtaaggtgagctagtcatagaattgtatagctgtaaagaccctaggaggtaccataattcaactcgtcttattttatggttgtggaaactgaggtgcagagaggctaagtgttctttgtaatgtcacaggggattttgtgacaataatcatcagcattggtagtgacacacattctcaaatgttgaaataaagaaaacaaaattaattcttgcactgaaaccatgcagtgttcccatctgagcagatcaagcctggcttatatgcctcaaagagaccaaattcaaagttctagtctgagattggttgatgtattattttcatttggttgttcttactattcccatgtttgcctgattcaactaggaatatcctgtaaatgtgccataaaatacttgacttagctttagcaaaacatttgacttttgtgaggtttcaatttagctacacctgtggctggttgagggctgagcatctacagagtacaagattgttaaatctagtaagttccagcctaggcattccttcttcatttttcctcatttggcttgctactgaggtgtcaggaaattgtacactcaagtctcaccttgacatttagtagcattgtcacctggcacaagatgcgacatatccattgcaacctgcccacccacccccatttctgtggtaagttgctctgcccttgcttctgcaggagtagtgttcatgtccgctgcttctccaccttctctaaccaggacgaaagtggtttgcatgcaggtagatgcttgatccacagacagctgatccataagtgggcctttaacatagggcatacatggcctggttcacaagaatgagccaggtaaacagtattttgaaatttgcaactaagatgttgtagggaccaatttcccctttgtcttttgaagggtcactgaaaatcaaatgacaaaaggcatattaataggagaaaagacatataagtttgataatgtgaatgggaagaaaaatcacagagtgattatcccaccacacaatggggtataaatggctatatattcttcttcttagggaaaggagatgaagaagtgaagatcatttaaaggggttagcaaatgatttttaggagcattcaatagcaatggacttgaagaacatacagtggcctgggataaaatctattgggcctgcagagcagacaactgtttgtgacaaaagtctgtcaggtgtgttgacagacttcagtctttcttcctgcgatttgagtttggttaatgaaaactcagaggaggaacccagagtaattgtggggttttttgttgtttgttttgttttgttttgtttttggtaggttcagactttacacagataagggaacttcggagaacagcttcattcagtgctttaggagagacagaggattgagagacaggaggtggggaagatcagagagaacttgcgaaaattctgaaaattttgaatgaggcccagttccagtttgtcagaagtttggctttctgacgactttctattgagcttgcatgagcactaggtctctttaatatatttttgtctttttagttaaataacttattttctgtaatttgcaaattaaacatacatactgaaacaagagctagtagtgacagtcttaatagtttactgccacggttgaaggataaaataaagatatcatcccccagaaatctgtcaattcttcttaaggtcttcagttatatttggaaagaatgaagctaaataaaacacattttcctaaaattattggaaacaaaaaaatagagttaagataaatatttgagttttctgaaatgctcaatttgtcttctacaatttccaccacacatttaaaaaaatgctcagagaacatgagcctgtggaaagaacaattgtctaagtaccaggaaacctgggtgttagatccacttctgtagtagaaatgactagtgctcacccatatctggttctcctctactttctggacacatgaaatatacatttcttggacccttaataaggaccctattacacttctggctggtagactgtgagcagaacttatacatgtcatttttgagctgcagctataactggcctggcaacccattcacattctccacctatcacagtgattctgaaaggtacaggtagagatgatgaagctgcaagatggagaatgcaaagctgtataaagtcatgtcttggaaaagagctgccctagaaaactacccaaattgcagcagactttgcattaacaagaaacacttttgagggctaagcccctgtgtattacagtttatacgttacacagcataacctatcccaccctgacgaggtagacttccagtgcctagataaagaagtcactgcttttccctatgctctgacttcttcaagcatctaaatgaagaaattggacttcattgcctccagtgactcttttagggtgtgcattcattctatcattcttctctgatgcctgccctacttactttgcagatttgctgagagggtgctttgaaacacccattgcatgggccttcccattgcatccttataaacaaaagattttgtcaaagttgaccgcttccaaaagagatcttgctatttctgaattaagcatttggagtgacgtcaattttaatttttaatttggctatgtgcaaatctttatcctttttggtgggaaaatttgaatagacttttctctttgttttgccagtattcaaaagcacaattttgagagtgcaaagaagcataactgacttagcaagtctgttagctctgctctcattcttcttgacctgcttctcttcatcacccaattgtgaatcttacctcttggtccttagctactatcctgattctacagatcagccctgcccaaaagtgcctgctgatagtcactgccatgacttgtaggcatgcttctgtaataatgtacacatatggtcttgacaggaaagaatctgctagatccttcacactcagtatcacatgattccagatacagactaaagatcaaaatattaccttggaaatcacaggttagaaaataatagctggttggtgagaatatttaatggtttgcatccagacaacttgagactctagttctgaatctgccacttcctatctgggcgacttttggcaagttacttaattctgtaaacttcagctctcttctttgtagtatgagttaacagcaagtacattatagtgtagttgagaaaataaaataagacagcttatgtaaaggacccagaataatgcttagctccataactagctacaaatgccagttttttcatttatcttatatgagggaggtaagggaagattatagatgttactgaccaaagggaaaggcctggatagagggaattataggagtaaagctatcataaagaccctgaatacggagaggagaaaccaagaagaaaatgtataattctcttctaaataaaaatggtaattcttataaattatctatttataattttgccctagactagcactacactatttttgtcaagaatgatgattaaaatttcttccattggcctcatgctttttacagatttttcccagttgagtttcaggtagagaagatctgaagaatagagatggaaaatatcattctttttttaaagaggagttctagagaatctaaagtttttttttgattgttcaatagttagtatccaaaccattagaaaaactcagatcttaaaacagctaaccagtcgggcgcggtggctcacgcctgtaatcccagcactttgggaggccgaggcgggtggatcatgagatcaggagtttgagaccatcctggctaacacggcgaaaccccgtctctactaaaaatacaaaaaattagccgggcgtggtggcgggagcctgtagtcccagctgctcaggaggctgaggcaggagaatggcatgaacctgggaggtggagcttgcagtgagcagagattgagccaccgcactccagcctgggagacagagctaggctctgtctcaaaaaaaaaaaaaaaaaaaaaaaaagcaactagccaatagactattcccacctgtaaagccttctttttactaggtatggtggtgtgttggtcatcaagtacacagattaacaagacaattcctgccctcaaggggatgaaaactgggtaagaaaaaaaaatttttttcagtccagcttgttaaataccatattggagaaaagcaaagttgtcagtggaactcagacatggggcacttaagctatcaaggatggaagtgctccgtgcacattcatgagatggaggtgggaagtcagacaagttctggcagggacattccctagctctgtccaactagtttagtattagctggcttctcacatttgggtgaggtttatggtcatcgaacttcctagcctccattaggaaaggtatgaacaatcagtctgtgcttctaagcttgattcctttggattttaagtgttttctgtttcatgagaactttgttaaaatgcaaattcctcataaatgtttagccttatcagtcagcaccatattgggaatgaataagcactgtgggatgtctaaaggaagggagttaagagacaggctccagcaaggagatgatggtaattggaaagatgtacaacagttccaaagacaaactatattaacttctctttgtggaccaaggttaggcaagacttctgtcgaccagttcttggaatctttggctcacttcaaccgtaacttctctataataaaaagtaagaaaagtaaagagttcattggctcagagcaagttaatcagaaaggattaaagcacatcaatctattttcatgtttgatagtagccctcattgaggcttgtgggacaatgatcaggtccttattgagcccagcagagaaggaggacccaatcttgctttatttctccccctaccctctttagtgctattttttttctaaaattgccctttcctttgttcagttcttcatcttctttgacaaggaattcaaaaactctcagaaattttaataaataatttacagtaaatatttatgacttaatatgtcatatctaaataaataaattgttaatgactaaatcaacacaacaataatgttagtaattgaatgttggaagtcacagacttcagcccataggtaaatctcccctctgcacacccatataaaaggataggcccaacaaaagtaatgaaactgggcattataatgggatcttggccatgagacacgaggaaaagaaaatatattttttaaatgggttgatggatgtttctatttataccaagtcactgatgttggaaagccaaatgagaaaagagaagaaagtttttatctaagaaatgtgagcccctttaaattatcaggcccagagaggctttaaaatgtgacaacagtcacatcttacttcccctctatgctaaacgattacctcttgaagccacttgctccataggctctagattaactgatgccaagtagccataaaatgccacacactggacaccataacttataacctatagttcaataacgtataatcaatcactaatcaatgttatcgctgtattgtccaacagaccgccaggatggctaaatagtataaaggagagctttattggcaatatcagtttgcaaaccaggaagagacagtctctggcatgtacctaaagtgctttctcttcaaagaggtaaaaggcaggttgatttttatacctcacagtctgtattacacaatagactcatacatactcagccggtttggggggtatgaggagagtcaagcacatgcacaaggggtaaacatatatgtaacatacttcccatgttcactttgaggtagagttttagcattaaaacaagctggaatttggctctttacatcaaaggtgaactttaaggcacaaagacagtttgtgtgcagcctctgaaagctgactgaagctggattaaagtctggagttgcttaagaggaaagaatgtttgaaggccactcccctgtccaatcagagttgtagtgatctgggttataaataagaggtagaaagggagtaacaatttgcttgatagctcctattgttaggaagtttagcaagagtgtggggtttttttgtttgaagctgtaagaatttaggaagttgctatgccagctgagctctgaattctgcgcccatagataatatttattttcttaaccttggggtctgtcttagttgataaaggagcatctattttggtttctcagatcacatctgtaaaccaacaaaaattcctgtcaaacaacttcgtatcagcccactctttttttcccttttccctttgaaaacctgcttgtaacaagccaaatgcagcacttcccagggcaacttggaaatgtgtcccagccattgtcctcactttggctaaagtaaactcttccattaaaattatatctgatgcctcagcttctttctttaggtggacataagtcatttcgaactcctctctatccaccgcactacgcatattcacattttttccatgtttttccaattttgagtctgatatgcttcttgaatcagtttttcaccactttccatcacctaccacctctgctctgcatcaaattgtcttctgctcaaatcagtagactatttccttacatgaccttcttacctttagccttggctcccttagatccatcttccccaaagtttccaggtttcaaaggcaacatccgatgatgcaaattctctttcaatagctccacatcttctttggatgatgctcagagcttctctccagtgcatctgaagcttttcatataacgatgatgaagacggctgatttttactgagcattactatgttccagatacattggatcagatcttttcatggacattacttactctctcaaaatagtcccctagaatagatgtgattatcctccttatgtctcttttacagaagaagaaaccactttcagagtttatttgccaggctaggaagtattggagaagagatttggtccaatgccagtcattaagtcttcccctgaatatgtgctcacaactagtatattacacttccctgcatctcctaaaccgaaatgacaaaccaaaacattttagagacccaatgtgtaagaataattgaatggaagtgatttcagcaaaagttcttctataggctgggtgcagtggctcaagcctgtaatcccagcactttgggaggccgaggcgggcagatcacgaggtcaggagatcgagaccatcctggctaacatggtgaaaccccgtctctactaaaaatacaaaaaaaaatttagctgggcatagtggtgggcgcctgtagtcccagctactctggaggctgaggcaggagaatggcgtgaacccgggaggcggagcttgcagtgagccgagattgcaccactgcactccagcctgggaaacagagcgagactacgtctaaaaaaaaaaaaaaaaaaagttcttccataattcagttgggaagagctaaactagccagccatatggttcagatgaaccagtgatctcctcaaattgatgtccagtgcctcactccccaaggtaaatagcaatgaggaatggttctactgacctccttaacttgtcataaaattcacacttttattcgttgtggaatgacacttttaatatttcttttgtagaagaaatccaggtttccaaaaagccactgacaaacatttcaagttaggcctggtggcactgcacttaaatcagtagttgaatttaatcatattcatttttgcactgaaatatttgtttctgtaactattgaaaaatttcactttgctgtttttttctctaaatgatcttttatttcaattatggaaaaatagaaaataaagcttctgaaacctatatctgtcagaaataatcatggaaatcattgggcatgtcaatagccatgttttaacatcaactgaatgccctttaagcaggccacctgtagtttgaattgtgcaggaaaaagaaaattgcaaggataagctcattttttcctgggaatatttcatagaaagttgtgctcaaagatcaaagtatgattagaatttttaatattaagctctgggaatggaaattctctttttatcatacataaatatagtttgaattatgcatagtctatcttcatgcatgctttcagaaggacatttctcagagagaggaagatgcacatggctttctaggttttccacctggaaaaggaagaaattcaaatgtttggatcccaattttcccagcatcatccttttcatgtccttaaaatctcactcagagaagctatttctttttcactcctgatagcaacagcgtgctgttggcctggagcttgatttgctgtagaggcagtaggctggggcttctctggggaacactgattaagcaggaattctgggagcaggcgatggctggcagagtggtggaagtgagcctgtgagggcagcagcagcacacagaagctcagtgtgcttctggtgacaaggtcttcagagactcttcctcgaggctggtttgcagctgggaacatcaatctctctcctgaccaggggcttattaacattctgagtatcactttcaattaaatttctccaatgctcatttagtttctagttaataaggcaggactggatgtcatgtatgatccagcaggttgtttttaaaggataaaaataaaaggagccctgggataagttaaagcgtgaggcactgttcctgggccaacatgttgcccaaaccactggcctccattggctttgcaggtggtctcagggcatgttttttaatgtacttttccctaatggaggatttcaatcagatattcactcttaggaaaaccaacacattgttccccgatggctgcacaaattcaaccagcttttttagttcaaattattgtgtgttttgtgtagtaaagaactcctataaacaaagaatggaagtagtttctaggaggtaccacaaatagaattcgccagcctctgaacagcttttttgaggtgataacgctaataatgaaaataatagcagtgagagtcactacttattcagtgtctattatctgtctatcactgcggtcagcacatcacttaaaaaccctcatttaattattacaacaatgctaagaggattaatgtccaattttggatggggaaactgagatacagagcttaatatccccatgatcaaagggctcatttgtgctaatagagaagtggtaactgtgtaaataataatcagtgtttcatcttcaggcttttccttcttctcttttccatctacttgaaagacttagaacagtgtagaatagtctcagcttcaaaacaggtctccacagacttcttggcgaacagaccactaaggtagaagggtgataaagtgggaggcaggcagggagaaggaacatagccccctttcctatgggaggagccaggaggagaagatgcatacaatcagcactttctgctctaggtcaagatgccctgcttattcttctaacctgggacagcagagacttgtcaagggctccaagattttggagttaaaccctaatctgggccctactatgcccttttctagttatgtgaccctgggaaactgacattattctgagcctcgggtgtttgtaaaggcatgactctcccaccctctggttaaaaaccttaatcctaggtgacaggagtaggtacatgaaccaggattggtcattcatagtgtctgtcccattctcttggacacataaatgactcagaaatggacttttgacttctgcaagccaggtctgtccagagaagcggactgcatttggagagggttcactagataagtaagattttcaaccagcctttgaccctactctacagggtaaaattacagaatttgattagattacattctctctacgtccaatgagctctaatcgtctattattccatctgaaggaaaatacacatacagtgtctcattccgtatagttggattatataaaattacacgtatgggggtggtgcttgaggcaaaatctgttaggtagtaatgaataactaaaacaaagaaatgctttaaaaggagttttgcaaaatggctctctgcactagagtttggaggtctcttttgaaataatgtttgaaaaccaacccactcacaagaaactttgtaatttttggtgtttttctttggcatgtgattccagacccataatgggagggaggtttaacggagacagggtttataaaatgctgagcggctgtgattagagcacaacggctttgtatagaaatgtgctaacaagaaacaataagtggcatttgaaataagaggcccaagggagaataggaattcatgaagaaaagaatgttaaaataaatacttgctgagtacctaatgcattcaaccaaaagcaaaacttttaatacacatttccagttgaaaatcagaaggtggcagcactgcttactgaatagtttcagatgaagcctccagggaaacctggagacagaataagccattttgtaggttataagcgcagctaatttatagctaaaaatgaaatgactatggctcatatgcacccctgaaacctctgagcctcttcggggatttggcatattgactctgtcatgggtgggtttcacctccaaggatgcagtgaactcagaaacatgccaaaatgaagagcaaggccctggccaaatttctttccatctgaaatgaaaaaggaaaagcccaaagtttggtccccacaactgaaacatcaaagtcccctgggaatttgtcagcaatactagttttccagcctcccctcagatctactgaatcagaagttttgagagtgaggtccagaaatgtggattttctaaactttccagctgattccagtgctggcttacatctgagaaccataaggagaggtatagagactattgttgtgatctgtgtttcaaaatgtggaacacgtcctcaaacaatatcttgctatggatatgtggactaacttcgtggtcctatttatagcctcagtcatattgaacagaaagagtgggcaaaaacagacgacttgcaagaaagtaattccttaaaaatggaccagaacaggcagtaattgatgaaagcacaaactagaggttttccccacaacatattgaatttctgcctacttgtcaatagctcagaaatcttcagaaaaataacttgttttgctgtgtgtcgttctatcagacaaatttacaagttattaaagagaaataaaactttgaaaattatttttaagcattctctgaataaatgcataataaaaatattatttgttcttactgtccaaacagaaaaaaaaaatgctggaggtgagaagtcaattacacttaaaaagcataaagactcttagaagtaattttgccactttaataggcattgactaaagcctagtccagaataattcatgcctgttttattaattaactttgtggttatacagtggagagtagataatagggccatcatgtccattaaatgaaagaacaagaccacagagggcaagaccacagacaaaccacccaaagtggtggctggctattctcagaggccttcaggagggacagtactttggtgtggtcatgaatttccaaggttttattttaatttggcagatttataaagttcatttttgcctggcatgcagagttgatcagttttgcagagatagtctttgtaaagaaacccacaatagagtcatatcaatattatctaccatgggttttgttttttgtttttttgtttggttcgttgtttgtttgtttgtttgtctgagacagtcttgctctgtcatccaggctggagtgcagtggcaggatcttggctcactgcaacctccacctcctggattcaagcgattctcctgcctccgcctcccgagtagctgggactaccgacatgcaccaccaggcctggctaatttttgtatttttaatagagacagggtttcaccctgttaggctggtcttgagctcctgatctcaggcaatccaactgccttggcctcacaaagtgctgggattacaggcctgagcaactgcacctggtccagcttttttttttcttttttttttttttaaacttgctgtgagccacggaagagccagccagaaagtctgctagctgatccacacatagccttggcaaatctaaatggagggtcaaatctggattgggaatggatgtgaagaacacaatatcgggtcacaaaaaaattatctggggcatcttaatacactaattcattcatctccactgtggatagagacctgtctctctatttgggtttggaattcacagcctcgttactcctggacggtatgtactcagcttctctgactgatttgtccatgctctgtgccaaacctcccctctcacttgaggcttttttttttttgaagtatgttaatatcatttattgagatttagttatatgtcattaaatttccaagaatgcctggtcatgggcaatattttgtctttattgtccttgattaacagcactgtacttctactcctgctaataatagtgtcatatttttcttttaatttggtttcaaggtctctctcaggagagcagctgtaaactctagccctgccctgacagtgctcttggggaggtggttgtgggtgtttacagtgtaccttccgtgggatacttctttgttctggtggaaaacctgatgcctaagtgtccaacgtgtgaccagatatccctctcacaggaaacttacttacactggcagatgcttaaggtcttgtgtgacctatgtccaatttattcctacaaagatagccattctgtaggagaactgactgggaaataggttcaggtgtgttggtcataggaggtggcacaacaaaacacatgaaatagcagaagcagtatattactcacaggtcccagagaagaggagcaccaatgagcaccaatgagaaggttgtggggacaccatgcgcagccaacaggttgggatttctaattggtggacttagagcaagcagacaagggtcacatgcattcatgttataacttaggagtgatcactacagcctctgagcacattccatgtggagtatgggactcagtaggatgagcctggtcaattgttatctatttttcccatatgaaagtggatactaggaggtgattttatagggaagatatcacgtctggatggaatacaagaagaaactgggaggaggaagacagctggaaactgggtcaaaggtgactaagctctgcttctggtgtgacagttaatgctatatgtactaaaaatgaatgccgaggcaacataaaattacaagtattccctatacatagctatcatgagagctcctaggtgccagagcctgggaatattagactgcttagttctagacctcctgaagtttacattgcagttaagaaaacaggaaactggacacacgactacaatttagtcatatggagcatgcaaagaggggagaagttgtggatgccagcgcataagagggagagtggtccttaattttgaggtcagagaaagcttcctctggcaggtgctaaactccaaacattagcagaaaacaagagcttttacagaccaaatgagttcacatggctttggcacacactgtgtggggattgggggagagagtaaaatggggaaagatcatgctagagacataagcttgtgtgagatcaagaaggatttaaattaagttgccgaagagtattttatgttggtggtaattgtgagacaagtaatagttttgagcagaaaagtgactacacgtaatttgcattttagaaaactcattcttatggagaaattatactatggattgaaaaagggtaatgtttgagggaggaatgccttgggttttcttgttttatttgtttttcaatatagatggctaataatggccgatagtatactcttactatatgccaagcattttacttgcatgttctcatttaatttttataatgatgctgtaacatagattgcactaggaattatcctaatggcacagagaagaaaagaaatagcaataggaagtttatgtaactcccccaaggtcacaaaactggtatgagttagagctgagatagaaactctatctgacgtcagagtctatgctctatttcactgcacccactgctgccttcaagctagagagaagataagctgaattagggagctgcatccagaaagtaaagaagaggacacattgggagctattgcagagcgagaaagggcaggtcttgacgactgcttggaggtaggtggtgcgagaagggagctggtaagaagaagtcttaagtttggctcaagatcattactaattttgctcccaacttcagtaacttcctctatatccttggacagtcttttcacttatttcctggtcccatctcttttgcttcacagtagcaatccaaaaattcctgctttcttctgcagacaccatgctactccatccctcctcagcatcaatggatgattacaccttctgattgttttggatctttggctgggaatggtggtgatgttcttctttgtgccaggtctaaattaaagaattggctctttatcacaacatttagaacatactatgaaaagaaagaaatcaatgaaaaacaggacctctttatttcctactcataataatatcaagtaagaacatctatttccagaagtagtttttcagccttttgctagagagagtttgttcttttgtttaaaatgcctgagctgataaggttcccagcctcaggagggacagatagagaggagaaaagttattttcccagaaatggcaggatgcattctgaccccttcctttatgttttagatgactgatagtgacaacatctaatagcaacttttattttctcatttagggccagtaaggctagcttttgctgttttcaaatgtaattattatagagtattgaatataacgatccagagaaagatccagatgtttctattttcttccgtagaaataactcatctattagatataatagacagtgccttgtggtacagcagtttaggaatatcattttactaagctcatctcttcctagatgcaggaaagtgaggactaagctctgatttttttatttgcccaaatttctatctaaggggtctagggactaatgacctacaaaccataaattctcatcagataggttttatttaaccctatatatcatggcttactttccaatctgaccctggcataacactatgagacaaggaagaaaataaaaatatttaactccaaaatagatttccttgccataccttgaaattggcctgcaaagtcttttatgggaaaaacccacattctatagagaattcccttttgttttccttccttccttcccagatccaagagataatcaactaagagtcaggcacccttttaggtcccataagaaatattttgcaacctgctctctctctctctgaagtctgctacctgagagctccctctgcacaataaaacttggtctccacaacctttatcttgacctgaacattcctttctatcaatcacaggtctttaaacaaactcaaccaattgtccaccagaatatgtttaaatttacctatagcctggaaacccccactttgagaagtcccgcctttctgaacaaaaccaatgtatttcttaagtgtatttgattgatgtttcatgcctccctgaaatatataaaaccaaactgtgctctgaccaccttggacacatgttcttaggactcccctagggctgtgtcacaggccatggtcactcatatttggctcagaataaatttctaaaaatattttacagagtttgactctttttgtcggcaaaagattatcacagaaaagtgtctgaaatggtctcttaaaatagtctgtctctcagttctagttgttatttgcaacagatggaaatactagtctttgtggcatggttcaagtatgagtttgctagaactgccatagaaaactaccacagactagatgagttaaataacagaaatttattttctcaaagttctggatgttggaagtccaagaccaaggtgttggcaggtctggtttcttctgaggcctctctccttagctcatagctggccaccttctccctcatgttctcacatgcccttttctctgtatgtattcctgatatctcttcctttcttatatgggtaccgatcagattgcattagggcccaccttaatgatctcattaacctcatcacctttctgaaagccctatctccaaatacagtcaaattctaaagcactagggcttaggatttcaacatacgaattttagggagacacaattcaaagcacataattgtatttactttgctgttatccaaaagcaatagcaacagtgagaaaaagcagaaaaagagctctggcctagaaaaaatatagaagtattacaagaacaccacccagtctgataacatttccaagctttggcaccagcgaatttttactgcttgcaaaaaggcaggcgtgaatttcttctgttggggtagccctattttggtttccctaaaaaaagcaagagtttcaaagtttcaagactctagaaaatgtaaaaatctttcagatggtttttactgccattctttctctgtttcaagagctaataaacacactgttattatcatattagttttatccttccacttatgagattttctttcttttccttttttctaatgaccaagcaaatcccctttctatgagcataatgaaggattttgcttacaatcaggcgtcaccctcaaagaggtgaaatatcttggctctttgataatctttcatgatcacttccaagaggaactttgcaggcatttgagttgccagacgtaaaatttggctttctgaaaaagaagcacatgtaactagctcataagctgcagtttgttaattatttttttctaaataaagaaaaaatatcattgaccagagtgatgagtaggagactttaggactctaaagagggattttctcaatgttcactctcacttcaaccctccccctacgcagaaacttctctacatctacttgtatatttgtttcttcactactaccatctaagtatagtagaaactactactaagaagctactaagctacacttagcttctactatacttagatgctagtagtgaagaaataaatatacaagtagatctagagaagtttctgtgtagggggaggattgaagtgaaaatgagccttggaagaagcatctaagtcatttccaactcttcttccactactgtgaggaatccatgtcctcctttctctgggcctttgcatttccaactatcccctctctaagtaatgccatgctcctccctccactgctttcctcttctttaactctgtgcgtgctcatgcctcctcccagatatatgatattatgatacatctacctacattcgagttcaattctgagtttctcaagtgcaaagatatgtcatatctttgtgtttccactgcctagcatgattcctcgcttattgttatttcttgataagcatctgatgaatgaaggaatgaatggatggatttacatgcatacagggcaaaacaacagaagttgattagtcaagtaaacatattttaatgatggcaataattgtttattgtttagaaaaataaaataaaacattcaatttcataaaagacagaatctataaaatcagaaaaatttatagttaattatctggatagtaaattttctgaaaataggcaatgttgataatttaggtaaagcttactgtctccttcatttttctgaaacagaaatagaggtttgaatgattttcaaagatgatccaactttcctcttgctcttggctatgttctatacagtgcaaattgagaagataaaacctaaacatttcattgtagtttgtctgtgttcatgatcacctggatgttttgcatggtatagatgtactcaggccttaagagactctctcagaatattcaggattctacttagtaaccctaggcttgctagctatttagtgggttagttttttaactgctaaatattttctgagcccttactaaatgtacagtaattgtgtcaagtattaggaagaacatagaaacatgtataaatgtaccttctgtaattgttgccatctacggtattatccaagacaatagacactaaattaaaacgaaatagtagagaggaaatgcttatgatctttaggaattgttgctaattgaaaaaacaaacaaaagaaattcttaacgttggcatgtttagtggtaattaggacctgtttttattgcatgctggatattagttgttatgtgcttattctcagctcattggaatacaagcagacacatctccaaaaagcagaataatctcaggaagacgttgccctctcctgagctaggtagaaggtcttgagctgtagcctgaactggtgtctgattgaagaatgcgtgcaggtgcctcctccatcagtctggtcccagaagacatcttgcagtttactacaagtttttaagaaagatgcagcggtctgtgaaaaggctaacatttctgcaggagagagaaatctgcctgacagataaacatccctccagcctttcctaagccctatttgtaaagaaagcttgatggaaagggaattctgtacaacttcaaggaaaaacagtggagagattgaatcaataggaagcatcctccttactcccatttcaggaaatccagagatcagtgtgctcttatttcaaaaggctgtcatccaacagagtcacatggtgatctgaaatcaccaaagccccagaggatggcacagggcaatgcaaaaagcatgaggctgagagtcaagtgacatgggttctgttctcagttctgtcaaggtttagctacatgaccttgggcaagccacataagcctgcttcctcagctataggacccagattgttttacctttgtctggcaaagcttttacgagaatggaatgaggtataatatgtaagtggacctgtattattcaattcttacattgctatgaagaactacctgagactgggtgatttgtaaagaaaagaggtttaatgcgttcacggttctgcaggttgtagaggaagtatggctgggaagccttaggaaacttacaatcatgacggaaggtgaaggggaagcaggcatagtcttcacatggccagagcaggagagataaaaagagaagaggggagtgctacacactttgaaacaaccagatctcatgagaattcactatcacaagaacagcaaaaaggaagtctgctcctgtgattcaatcacctcccaccaggcccctctttcaacacatggggattacagttggacctgagatttgagtgggaacatggagccaaatcatatcagtactcaactcagtgcttggcatatggtaagaacaaaaccacaaccatagctagaggcctttctcgggcatgagcaggctgtctggttggaggatttcagggagcctgagtgcactttacccattattccttctctcactgctatgggacaccttccagatacatagcttctcagctgattgcttcagtgacttaataatggataaactgcttcttctatctctagtggaaaaaataaagcctgggacacagagtggctcaaaggggagcactagcctgtgtggggagcactagcctgtgtgaggagcaccggcctgtgtgagaatccctgctcaactcctgctcagctctatgaactttgggtgcattcattgtttaaagcctcagtttccttatctgtaaaacaagggggctagaaatatggggtagaacatttgaggtggactaagatggaaaaggagaatagtaacttcccactgacctgtggccctttcagtggctgctctgcccaagagccatatactcatgacttctgatggggacaaagacctaaagcgcttgtggtaattgtcctggaatccttccgcaattctattctttctcctcttcagtcgtttatttcttccagatatgtggggagagcttagggtgcctcatggaagcccagaagcccacccctgaaatgtctcccctatcctaattcaagacaggtatggcctgcagttcccagcactagaaatagagtttcccttcaactcatcccctatttactctgcccatttcctagtttgaggtttcaggatctgagtttgctatcaggattgaaacatcaaagtaccttagttttttgtcacatttgctaaatggttgtcattctacaaaatgttttgtacatgttaggaaaatgataatctaaataagggaattaccatggaggagtttctttgagagatttacgtgcaggggattttctaacacctctttcaaccccttttccacctatccataagccctcttaggaacaaggcaagccatcatttgtcaattcatataaatatgattaattgtatgaatgacgactgaaagctaaggtcaatttctgatgtagaatctatgttcttggaacggtggctcacacctgtaatcccagcactgtgggaggccaagatgggcagatcacctaaggtcaggagttcaagacaagccttcccaacatagcaaaaccccatctctactaaaaatacaaaaagtaaccaagtgtagtggcacgcacctgtaatcccagctacttgggaggctgagacaggagaatcgcttgaacctgggaggtagaggttgcagtgagccaagactgagccactgcactccagcctgggtgacagagcaagactccatcacacacacaaaaaaaagagagaaagatatctgtcagttttacctgccaggcattcatttacattcttctggtggcaacgtttagattttcctttagggaacttctccattgcatgcaatctcattgttattttcaaactaagagcccctcattcttaaggagtggaaggtaacccagtctaactcaatcagactatctcttctcaatacatgtgttttcagcaaagtggctcaaaagtgtaaactatcaccaggtcattcattcatcataaaaactgtggaagtcagtgttgcaattcctctgggatctagaactagaaatgccatttgacccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgtaaggacaaaaaaccaaacaccgcatgttctcactcacaggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtaataataaaataaaaattaaaaaaaaacttaaatgtacttctattcttgctccctagatattcagagatatcttgtttctatccttcgtatgatcaggttgttcaataattcctccaattctgtgggctatccccttccaataagtttatttttcactctaagccagatgcatttcaagtgcctgcaaccaactaaccagactaagtgaaaaatgaaaggaaaatatagcatatttttgaaggtctgatgttggaggcagaaacagactatggacaagtgattaggttgctttccaaaagtttggtcctatttcagtcgtttaaatttggggtccattttcttcatgggatagtttctgtagtatatactgtacctgaaatatagacttcatgataccatagtttagagtaattttgaataatgattattgtgaaatctgttgagagttccaaatttaaaaaacattactgggttccaaattaaatagtttatttcctgtgggatatgtggataacaggtactttatatttgtggcatttatgttattaaaataattttacaaggtaattttatcttcatttttctgttataaagaacttgaagctcaaatagggaagaatcattgagcttatagaagatttggatgggaacccagctgtcctttgttacaaagcctgcactcctacatctgtctaccaaagctacttaccaggcatgcataacctttctgtaccttatcccagaaccaaaggagaatatctgcctatcagaagaaagataaataatgtgagtttctttccactattattcttgcagttcagggtaatttctgtgcagcagcaaagactaagagagccacataagaggagagctggatgggtgctaatgatggagagagtgtcaaggagaaaggaggtgttgggagtaggtgctctggcttaaaattcttggaggagagttcactcctatcctctccttgtttctcatcttggcctataggaacaggaagagaaagcagtccggagtctagccccctattatatgttcaattgtgttccccaaaaagattttttgaaattctaacacttggtacctataaatatgaccttatttggaaataaggtctttgcagatgcactcaagttcagatgaggtcattagggagtctctaatccaatgtgattggtgttcttataagaagaggagaacaccacgtgaacatagaaacacacagggagaatatgatcacatgaagatggaggcagatgctggagttacgctgtcacaagccacggggtgcccaggaccaccagaaactgaaagaggcaagaaaggattcttttctggagacttcagagagaacatggctatgtagataacttgattttaagcttctttcctttagaaatgtcagagaataaatatgttactttaagccaccagtttgtggtactttgttccagcaggggatttacctaacaccacaaggagtcaacaaaccagttgcctaaagagccaacatctcaaaaattttacctttcataagtgcagatgtacaaaaaaggtatctcttctttactgagaaaattttaacatttttacatatgtgcacaatacttacacaaaaagtcaacattgtattaatttactttcatggagtcacatttgcaaagaaacatataaaactagaattctctaacagcctttccataatttatacctccagtacaggaaatgatgcaaagatgaaatacatagcacagcaaattgcaaaaactaatgttgactaatgttaaaatagtgaaaaaaaattaaaaaggaaaaagaaaaggagaagaagaaaaaactaaaaaatatttggcatatgaaaagtataatgcaggaatagattatgagcaatggcacgtagatagttcctaagagctggctgatttcacaatcattaactatattttgaaatcttgcatcacaattaatagctgcttttttttcttttaatacatgctttccttggagaatacattcacattcattttttatgtggcactgcttttttgaaattcttctttgattcagcatatactaatatgagcattccctattacattttcccatcttttgcaccttgtttctatgttgttttgggtatgcagaaatccattttgcatgcactcaaatacagaccacacatttgaaagaaacaatactggtgatcgaacagcaacactgtgtgtttaagtgttttcttatcccaccatgtacataatcatttttgaaccagtccatcagcaactttgctggcttcttcaggcaaatgcaactttaatacattaaaatctcctggaagtcatcagctagaagaaatgccaatgcaggcaaacgaggcatttttaaactgaagttttagtccttgccatatcgtgtggacaatgcacacatttgaattttttgacaaatgcattgagctaaatggaagaaaaaaattttagtaacaccttgaaattcacttttagaagtcttaatcacacctaattccaaatccatcactatggttcagagaatcaactgaaatccattttcttctgcgtaaagacaaaagcaaggtaatagctctgcctaacatgaagcaatattcctgtgactgtgatttttggaattcagatgttagagattttagattttagggattttgatctttagggattttggtctttcaggctttcaacatttataattatggtgttcaagagtacatcttttgggattatgattcaaatcctgattccccaactgtcttcgggaagaaggcaatatcatgttgtgagtttatggatgaatggaaaaggaccacagcaaagttgaatttgcttgaagtttctttttttttctttcatatccatacccttgcatggaaatagaaaaaaaaaaaagtagctcgtaaagttaagaatatggataaaggcaggtaaaatggaatttttaaattttgagaaatcacagatacaattattacaacctctataagtgaaaataagcaatattcccaaatctacaaaatgtgaatcctgtaaaagtgtatcaagagctcagcatccttagcctctctgttgattttgagtgtcaacgctgcagcccactgattgtgtgttctctttgtgactgttttctcacctataaaataaagattgtataatgaactgagtttgctcatctgtaaaaggtgaggttgtaaggattaaatgatttaatacttataaaatgtaaaacaagaagtttcatagagccacatgggaagtgcttaatacgtgttagctattgatagtggtatgtcctataaataagattgcctgtcttgtcttggtggtggatgtgatcgggttcaaaaataaattgggttttggtcttgtcctcaggtagtttgctaataagcaactttattacaagatcgaaggttataagtattctaagcaaaaccccaatttctaggccacagatactgaaaaggatacttcccagcaatggtggcatttgaagtggacttgaagcaaactgatatttaaccaagcagagttctgattacatggagggattggcacaatcaaagcacagaacagtgtaaagttcctgattcggttgagtagaggacacagtgattggacatgcaacatagctggacagatctgatgatggcatgccctgctgaggattctgaaccttatttctatgggcaacaaggagtcatagaagatgtttgagcaaagagtaataggattatagcttcagctgtaaaaaggcacacacaaaatcagtttatctaaggagactattggaagtgtgggaagttagagaagaaaaggccaatttggaagctattttcaacaatcgaataagagacaaaaatcagtgaagactgaacggtagttgaatttgtcattgggaggagttaatgatttgtatcagaagttaggatggcctgtgctaacattagaacatgaagatcagagagggagtgattctgagcaggaagtagaagagaatgctaaataaagtgagctatctacactgacaaataagtttgaaatagaggcagttatgcggagaatgcaggctacaaaatggtgttacatgtagaagagggataggcgagctatgacctggtggaatcttggttgatgcctgtgtttgtacagttctttggctgcttttgcactataagggcagagatgagaacctgtaacagtgaccatatggccacaatgcctaatttgtttttttttagacggagtctcactctgtcgcccaagctggagtgtagtggcacaatctcggcccactgcaacctccacatcccaggttcaagcgattctcctgcctcggcctcctgagtaactgggactacaggtgcccattaccacgtctggccaatttttgtatttttagtagagacggggtttcaccatattggccaggctggtctcgaactcctgaccttgtgatctgcccattttggcctcccaaagtgcttggatgacaggcgtgagccaccgtgcctggccacaatgcctgcaatattaattactgggccgtttacaaaaattgttgctgatccctgatcaagaatatcttgataattgaagtaatatttgaactcaaattagctaatataactgccttgttattccttttgaagtgttttgaaaacagcttcagaggtttcaaagactttactagaagcttgggaactagcaagcttctaaaagaaacatgtggatggaggaggtacctgcctcatgccagagtttactactttattgacaaaaggtcaccacacaaacatatgcaaacaatagattttgtttatttaatctatcaaacatatgcaatgatagattttgttgtatttctccaggaagaagaaaataaaaggaacatattatcagattattttaattcaaggtcagaatttttttaattaaaattggattctagtctgcaagtgagtgcacagagagcaaaaagaaatacatggtatgatggctgccctctagaaatttttaattttccacaaacaaatatccatatataaaaataaatgaaaataatataaggaaatgctgactgtactgaaggagaagtaatgtgataattgatttccatttctttcctgctttccgtctgtttatagagtcacggacaaagacaagtgtctacagaaactaaatgttttgaacatcaggacactttaaatacaaatccagagaaggggcttctctttaaatatcacaagaactggcaaaagttggcttgcagacctcccaagtcaggaggcctctggaactggccgtgtgagcctctgttcacgtagtccccactgtcctttctcatctcatgctgagtcagctttcctaatttttatttcccattggtctttcaaagcaattgacttgtaatccttgctttggaagtgctatcaacttcatcatggttaacagcagcagagaagggagcccctaacaatgtgccttgctgttagtttcttgactacttttgtgccatttcccactgcactttcattttgtctctccttttctttatttccatcactagttttccaccagcaggaaattgccagaaaagaattacacagctgaccctctttcctagtccctgtttccttttattcacctctctttcatcctattccctcttgtttcaatccttacccaaatgtcttttgaaatgccaatagaaataaccatagtgacactttgctcaatagatgtcccagtggttcaaagagcaatcctctttggcctcacccactgggttctatttctgctgagccaagtacatttaattcactcgttcatttgctctgaccctgttatcagtcttattttttctttccttcctctgctcccagatcagaaaaatcaatacatttgttaacaatgtaaaaaaattaaaaatcagtcaaagaaatcagggaactaaagtttcaaataggtaagtgacttgcccatagctgcggaattcagtcttgcatgatcagtcctcaggagatggaagtctggacttgatgtctctggagcctagggtgattgcagggatggaacatagggctatgaaaggttgacctgagaatgatgctagaaaaagtgagcttctttcttcctttgcatttgatgagcaaaccccaaaggagagccaggaaacagattgttgtttagaactctgaataaggaatcaaagcaagctgctctaggagttttccaatgacaaaatggaaatggaaacctgaatgagtaatcacaaggaacaagatgctattatctttcttcagctgcctcatgccccctcttcacttaagcataaaatggataaaaatcagaaaaacaaaacctgtcaatgaaacattgtttctgaaactcaggttgaaacataaaagagacttccctaggctagtcactatatatacactgatatatacatatatgtgtatacattcttagaatactctctaaatatcacttagttctgaatgatgtactgtgtcatcttagactaaaggtcaagtgaaggagagttctctgtttctctcattaagtaactcatatatagataagagaagaattgagggagaatgatgagtctgccctttcccatccccggttctccacatttagatgttagtcacacacacagtattattcctttaggatgcttcttacctgataactttcctttaagaataataaactgttgtccttcactattaaaaatgggactttggtctgtcttcctttttatcagtcttttatcctttgtaagtgtgataactataagatcctttatttaagggccgttgaaaggatttttagacacaaatactatacttttgaatataaatataccaaagtcacctccaatgtacattttccatcacttagctgcattcaactgtgttgatatagaagcatttgtcatatacagcattagcatacacatgtatgtatggcattttaaaatgataaaatatatagaaatacaaaaaatgtatgagcacagtttaacacatggctgtaaggggaaaacctgaaaccattcctaagtcagaaattagaacttttcagaaaaatatgaaatgcttcatgagtttcccattcttcacagtttgttctttcttctctggatcattccagttggagatcatgggcttctgtatttttagtattattcttggttactacagtcccacttggttatttcattcaattcctaaaaatacttatttgaactttgcacttctgttctaaattttctagggaacttttttttctcatgtaaacactagatcatctcatttagttaatgcattcctcggagaatgtgctctaaaccagtgccactcaaattacggtctatcagtgccaagctgtaaactgttggttactggccccccatgaaattgagtgtagagactgagagtaagctcttaaaatatttatagcaatttttcaaagaaattttatgacttgaatccagtaataaaaaaatagaaacttgcacattttatctgtcatttttattttatttttctagacatttatttttattccattttacagaagtatatatccatgaaaaactggaagtaaaacaaaattaaacaaaaatctgttttcgtttttgtttttttgttttaccagaatagtttgagaagtgctagtgtagggagcagaaactgcttgcaggctgcatttccctttatggacccgtgagaaacatgcatcttgagcatccaaatttgttcacgtaggacaaagggaattttcttttttttttttatttttttttattttatttatttatttatttatttatttatttatttattttaaattttttttttattatactttaagttttagggtacatgtgcacattgtgcaggttagttacatatgtttacatgtgccatgctggtgcactgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgcgtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagcccttaggacaaagggaattttctaacatgagctgaagatctggagttcccagccatgtcttttataaagactcaacttccagaacagaatgggttgctttacttctatgttttcaccagcacctttcttgcccaatgactgccagtcctgtgccatgtacctcttttcttacccatcaataatggttaaaaattattagatttagaaaaggtatataaacaaagacacttattctagcactgcttttattttattttattttattttattttattttattttattttattttattttttgagacagagtctcactctgtcgcccaggctagagtgcagcggcacgatcttggttcactgcaacctctgcctcctatcctcttgccttggtctcacaacaagccgggattacaggcatgagccaccacacgcagtccaagcactgcttttaaatatcaaaaaatacatgaacgccaaagagaaaagcgttagtacactaaatgatgctgcatacaatgatggcacaactgcaatcattccaaattatgttgtaaatttgtcctagatcctccacataatgctgtgttaaggaaataatttaggctacaaaggagtatatttagtgtgataagtttttgtaaagaaaatatatgtgttcagatgcagagaaacatgggcataaaaatgttctcaataattatcctttagtggtagaaatatgtgtattttctaagttttttcccttgtgcttttctgtgttttgtatcaaatacttttttatatgtttgtttaaagtacataaaagaaatgggaaagaataggagaactgtgaaaaaaatggagagtcaagtaatccaaggcaaaaatgtcatgaaggcaaagtatgttgaaggctgagtggaggacaggaaacaactccatgcaatggcaccagaattttggaagttgttaaaaaaaaaataagataaaaaactggtctcaccccagaccagattaatcagtattttagaggggagggaacagacatcaatatatttttttttttttgagatggagtcttgctgtgtcgcccaggctggagtgcagtggcacaatcttggctcactgcaaactctgcctcccaggttcacaccattctcctgcctcagcctcccgagtagctgggaccacaggcgcctgccaccacgcccagctaattttttgtacttttagtagagacggggtttcaccgtgttagccaagagggtctcgatctcctaacctcgtgatccgcccgcctcagcctcccaaagtgctgggaatacaggcgtgagccaccgctcccagccacatcaatacttttaacacttcctcaaggagcccagtgttcctccaggtttgagagtcgttgggtagatgccagccagcctattctaccaaattagtccatgctggctggctggctttcaggaataggagttacattattccaaacagaaggctaacaataaaaataacaggattcgtctctcacaaagcattttatcccctcagcattggtggcctaaagctgaggattatttgtatgtgattacaagttttggagacaccagttgaaattatctaaacattctgaatattaaaacctaagtatttaatgtgataaaactatgatctggaagttgaatggagtgattgctttgcgggtatacagagctgcatctaagtcaaccctcttgaaaatgttaattagcaccaaacaaagaacaatggaagatgtctgcttttttccttggagaccaagatagggacaagtcgttttgcatgtgcgcagaatgtggaaatggcaaagaggtttaaataacgaattttaataagtttcatcccactgggagagacacttctgattatctgtgacctatacaaattatcatgattctccccactggcctaccataattttaataagtaatcaaactaagcttgaaggttctgcaaaatgccaaatatatacaagtgcttttgctagttacaaagctagtacttgctacctgacctttttacaatttctccaactacttattcacaccccagccacaggtttaaatgctcagcgttcatttggtccttattgatcctaggctgctacctgtttgggctgagaaatgaccttctgtggacatctagggagtcttgccctgctgtgagaagaatttcaaaagaagtttggccagaaatttaatgcagatctgaaaaggttgctagcgaagctacatgtagtggaatgagatacaataagtccctagtgatggtccaggcccaggcaagtacctaagcacaatggcgttcaccaatgagctagcagaaggttaacgagggcagagcatatagaaacaggtgcttcgggctcctgggagatttctttacctctctccaggtttcaatctatttcctcactccagcctcactctccaaattgtaacttacatgttgggagcttaagctgaaaacctcattaaaatcttgttctcttctcctgccccgtgatttggcttttgcatccttgactctacaccagtactttttaaactttaatgtgcttaccagtcgcccgggattttattaaagtgcagattgtgaataggtcagtagatctggcatggggcctaagacatgaatttctaagaagctcccaggtgatgcttctgctattgtgccagaccacagcatgtgcagcatggccccagttactagttcctacccccagaatttatgaggcagttgtctggggtggggccaggaatttgcatttctacttagttcccaaatgatgccaatggtcagggtctacacactgagaaccactgccttagcctgctgctcccaactgatttgagctgtcactactcagaagggcaggttgctgccccttcccctgccatgtgctggttccccctactctcttggcagttttttcagggatgggagtcgaaagataatcatcttcttactcttcaggtatctgtaagatagaaaaagaaatcctgccaaagttgaagaacgtctcccaaccttttagacactgaaattctatagaaatagagaagaaaaaatgaaacaaagcaaaagaaaatgacccaactactcagattagagcctcgaattaaaaactgacagacaggctgctttacatcatcctgaaattacttgtgcctggtctcagactaaggctcctgcctatagctgtacagtaaagatatcagtttgttactcaccgccaagagcctgaggaggcaggactcaaggttctgttcatagcagagcttctcactgtgctcacacttgtgcaggcatcagactgtcctgcagggctgttaaaatgactcttggtccagggtggggccagagaacttgtgtttctaaaacgttctgttactcataggactggtaccagaccacacttagagaaccactcaaattgaatgacacccctgttttacttgcttccgttttccaccaattaagaaatggcagtcacaggaaaggaaagtaaaatcataggtttgctgatgaagctgaaatggggaaatatggtataggcagagattgtcaatggatttcttaaggctgaaccccagagttagacatacatgtgcacccactcacgggcagcactggatcctgtgagcatcccttgatggggacctgcccatggaaaatgtaagacatggagaaacagagtggggacacacacttcctgcaggcagctagctcctgaagagaatgaggaggggaaggggaggaggtgggcaagctcagttccttctgtcaaacccaacaatcaggtaaaacactccacactcccaaataatgcaggaaatgagggactcaagaaagatcaggtaggatgagctaggctaatggatgtccctcccttagaaacaggaatagtcaatcaatagccctcctcccaaagaaactaatgtccaagcttgccaaccccctcccacaccaaataccaggctttttgccccaatgagtttaatcagtaactaaattgagttcaaattctatcccagcttagactggttatttagcccgtatgagccttagtgttatgcctacaacattgggataatgtaagtcttatctccagtgatcgctgtgaggattaaacaagctatcactttgtatctaggagggactctccatataacaattttccttccttctctgtcttccttcatctcttagccttgtgacttgatatgataaaatatgttatattgtacttgctcttagaaaacctgcaatctcgagaaaaagtatagaaatatgaaaatgggctgggcgcggtggctcacgcctgtaatcccagcactttgggaggccgaggtgggcagatcacgaggtcaggagattgagaccatcctggctaacacggtgaaaccccatctatacttaaaatacaaaaaattagccaggcgtggtggcgggcgactgtactcccagctgcttcagaggctgaggcaggagaatggcatgaacccgggagggggagcttgcagtgagcccagatggcgccactgaactccagcctgggtgacagagtgagactccttctcaaaaaaaaaaaaaaaaaaaaaaaagaaaagaaatatgaaaatgttaaatacagcataaggcaatgttttgaaactatgaagagaaaatagtgtgaagactaaagcagatgatatgtaaaatgcttagtgattagtagttgcttagtttaacatttttctaaaaatcgcagttcaaactggaagattgggaaagaagctagagttttctatagtggctccataggaaatctgtggctttggttggcttcaggaggaaagccaactgctaatcatgggacagggtaaggatagttgagggatggggaacagcatgggccgaggcttagtacaagggacccgagagacaggcggacacacctggatgggtggtcacttgttctgttcacaatcagttcttgtcctgagccaatcaccagacttaaaaggtccccacgctgtagtcttttatatcattgcccattcagttcgcaggcattgagagcataactagtagcaatttctctgccttttatgtataatgattcgattgatttgaatgtcagggcatgtctctaagtctagagggtaagcagtccatcctgtgagggagcatagttatttttctttctttaagtcaatgactctctttgatggtggctgcacattcaaatcacctgggagcattaaaaatagtagcaaagctctaccttttatcaataaacttcaaatctcaaagggtggaggctggcatatatattttcttaagagctcttcagatgattctagcatgcggcctaggtcaggaaagtctgtggccaaggcagcctgttcactcgtgtggaaatggcatttctaagcattgatttttctcaggaacaattaggaagcaattaacaaacaattaaccagactgttagtatgctatagataagcaccaaacctgcatgggattttgaaataaaataaccaagaaaagcatgtttttcaaatgtaaactgggatactgttttacatgctaaataaatggcctggcaaacaaaggggctatatttatataaatggttaacttttagtcatgtttctaaatcacacgttattttgcaataaaataaagattatgaagacagaacaacttaataaaaacatgtacttgactatttgagttgagtaagatcatatttatcttttcttatgactaatagctagttggatattttgtttctgaagtggtaagctgtttaaacaagtataaaggagaaatcttatttggttagcaggaccaggaagtgaatctatgttagtgtccagtttccattcattaacttattcattcaataaatatttattgaatttcctccattgtgtacctagcattagactagaaagtggttacactgtttgttttgttgctgttgttatttttagagacagggtctcactctgttacccaggctggagtgcaatggcacaatcatggcttactgcaaactcatcctcctgggctcaagtgatcctccccgcttcaccctccagagtacctgagactaaggtgtgtgccaccatatccggcaactatcagtattgttgactaaagcaggtttggtttctgaacttctgttttaggtacttataatctaatggaagaaagatgataataaatgatgagttgtgctaagtgcaatgaagaaagcaaacaggatatagcaattgaggaaaactgtgtgtgtgttttgtgaggtgttctactgtgatagaatctgaagatcctatccactcttctgaaccaagaatgcagaataaagtggagccaactttcagacttagagcactgtaaggcagaaggcccaggcaaagaagaatttagcctgtgagaggctctgaaagataaatgtgctaaaatagggagtagtcacacacatgcattcatgataattatttttttcctcagtttgttcttttgcatatctttatttttccttttaagaccaattgaagtcaatatttattgagtattttctatgtgtcagtagttaaaatagtctgagacagtgctaggaagaaattaaaaaaaaaaaaaaaaagaaattaaaacctgatgggagaaacaaccctgacctaagagaggcagattgtacttgctcttaaaaaaagtgcaatcttgagaacaagtatagaaatatgaaaatgttaaatacaatataaggcaatgttttgaaactataaagagaaattagtgtgaagactaaaggagatgatatgtaaaatgcttagtgatttgtagttgcttagtttaacatttttctaaaaatcatagttcaaactggaagagtgggaaaggtagaggtgtctctaagaaagacatgcatacaagttatgaaagtgtgtgcagtcagaaaaaggcaaaggagggtgtctagctttccctgggggatctgcaacatcaggcaggaatttttccatgagaaggccctcatagaccccagggaatcatggagatgatccaaggatgtttggttggcaacagttaagctggtgaggaggaacacattaattagttatgcctagataagaaaactggagagtcaactcaagtcagctttccaaatcagtcatccaatccgaatgcttctaaaataatgaacaattaaaagtaatttcacactggttctcagttctagctgcacgttagagttacctaggcatcttcctaaagcactggggtctaaaccccactgcagacaaatgacacagtctctgtagggcaggtccaagaagagcatgggacgtacatttacgaaagatgatgaactactgcctcatcctcataggacctcagtcttcataagtagtgccaattcaatatggcaagaccacagtctctcccttaatctctacttttttttttcctgtctgagtaaatttactcaaagaaccagttcaaatattacctctaaaatgaaacatttatttatactcctaggaaaaattatttcttagcaaaagagttaaggaagccccgttgaggtattttgtacattgattttcctgtgattacatatgaggttacacagtcctcaagggtttgattgcattaaaatacatagcacctagcctaacgctcacaacatatcaagtcttgaatataggaaggaaggaaggaaggagagggagaaagaaatgaagaaaggaaggaggagagggagtaaaggaaggaaggaggaagggaggcagacagaagggaaaaaaggaagggagagaggggtggggagggagagaggtgggagaaaagaagaaagagggatggaagggagggagaaaaatgggcaggaggaagggtggggaagagggaggaaggaaggaaagaaagggaagagggagaaaggaaggaaagaatgggggcgagagaaaggaaggaagagggaagggagaaaggagggaaggaaagaaggaagagaagtagggagagggggagggaggagggagaagtaaaagaaggaaaggagggagggagagagagagagggaaggaaggaaggaaagaaggaaggaaggaaaaaagattcattaataagaatgattcaattagtttgcataccaggctgtgcctttggcagctgagggtgttcaggtaccagagacctaagagaaagggtacaaaaaggaaagatagaagtgccagggagactacttgtatgagggcttcagcagcatttttaacttaccatttgatgtttttagctttagaatactttcctcaaatatatataacagaaattagtagccttaagtgtggtcccctgaccaacagcatcttgggatttgttagaaatgcaaattctcacaacctgccccagacctaccacaccagcaactctggggttagggcccagcattctgattttgcaagcgtttccacgtgtttccgatgtgtcctcaagcttgagaaccgctggtgtagataaaagtcgacttactttggttgaaacacagctagtaaatagctgtcaattcctactccctttccatgcaaatacacacaaatacagtcctgtggagtctgtctccatagagtccccaagtcctcacacaacgaagttgaataagctggtcttgcaagtgtgagcctccctctatgttatacacagtctcagtgttgcctgactccagagttcccgtggttctccacatgtgaacttcaagaggaattatttctcttgatgacttttagattcagacttttgctaattcacacaatcccaaatctgatgattgccagaactttgtctgattaaaaaagaaaaagtcagttaaagcagttttcagtttggtatatgcagcctacccaactctgttcactttctaccaaacaatccttccctaatattgtaaccttcaagagtggtcccaaagccatccacacttctgtaggcaccattgacatagcatatgctgagcagattcccaagctgccatttcacccaatcatattttagacagttgaagtctttatttgagaagcattccgatctgagggttttttccctcgtctacttaaaatttcatagctgtgttaatttatcacccctcctcattgcgtagcttctgagtaagttatacagtaatggtgaatgataaatcagagggccaggcctatattactcatgacattgtaatagtattaatctgagatagcttttaattgtccgttctacagtctttaatgctaagaagatatagaggtttccattattctaattgtatttcaaataaatgtatgggctcaaatttttcctctctgttaaaaaaaaggctaaattagagatgtcttgcatataaaatgaattattttacagcaaaactttgattaatcacactgaaaaatagcagaaatctcaactgtatgtatgttgtctgcacttagtttgtcagaaaatgacaaaaagggtcagaaaataaggtttcatcgtgaaattaaaaaacgaaatttcaaaaaactttcaaagcaaccccctatgcctttcatatctgtaatctagttaagtgaaaatggatgttcagataacctgtggtccttttagctatcaagcaaaaagtggattattttcaaaggcttcatttgcaagataagaaatggattaatgcattttcaaagtactttcaacaagactattgagacaaattaggttaattttgaagttattgaaaagaccactttccaagtattccagtcaatcaaactttaattacagtaactacatatattgatcatacttagaagaaaaaggcagttacccagaaaagtgaaatttcctggtaattgatgctttccatatgaagcaccaaaacatttggatatgaactattgtggttgtagttaaaccatttgcagtctgactaaacagagaacagtgactgtctttagatattcctcatggcatttgtatcagttggcatcattcatacgagcacagtgaataaagcaggaactggtctataaagcattcttatctttcagacagtggaactcagtatatttactttcttctacattaaggagtccaagacgggtgctgtaaatcttttttttttttcttttaataaactctttagttttatcttcccctcctgctgtctcttggtggccactgctaaactaaggtctctagcaagaatttctatggagttctttgggtccatgtctgaaagtggccctctgtctatcttacttcacaaccagaaggttgtggggacaaggcaagtactttggaccagaaaagcagatcacagaagatttataagtgtttaggcagcagtaggtcagatgccagaggaataaattgagatcaagagtgcaaaatgagaattcccaagtatatgcgattagacagagcctggaaaattgccaggaactggtgggggtgggcagtgatgggggtgggtcagcacaagatgatgtccaagtgccaggccaaatagcaagtaagagatctctggaaattgaagcagacggacaaatttgaaataaaataaaataaacagaatttggaatcagttatatggaaaagacacagagaagcaattgatattttagcttcaatatttcttacttcttaaatcgtcaagtcacccacttctcaccacctgcaccattaccaccctaatctgagctatcatatctcttccataaacgctaatcctgtagaagtccctccagctggtctccacaggcaggcgatgccattgctggcccacccagatcctctttaccaggcaggtgcgtccatcccccagcagctatgagcattggctgctaatagtccccagcagctatgagcattggctgctaatagtccccagtggcatccttcctctgagaaccgtcctagcatataggaaaatacctgggagagtagcgcaccctccctttggcgtgcatcccccagccaattaattaacagaaatccaaaggctggctcctcaacttgaggtgagataaacctgtggtaccatgcagactccaggtatacctgtaggatcaggtacagtgaaaacagatgtcagttaaagcaggtcttcattgaacaaacttctaacctggaagtacaagtatttcattttcctcaattccttactgttttttatctatatattaaatatatatatatatattttcctaggccctctcccacttggacaagtacctatctctcaaaccctgcttctgggaagccttatataagatgcactgtcttcacatttgctgccctgtagcataagtaaatacagttatttaacttaggataatgccatatgatttgccaaaattgtattttgaattttgttctagacagaagaaattttatatcattaagatgagtgaaattcctattaaaaaggataaaagcgcaactcgatttctgacttcataaagattgaatattgtttcttactcattctacttggaaatagtcaagaaactctctgaaagtagaatatttcaaaaaattctgagaaaattaagatatttagaaacaaaaaggatagctgttttgaaaaataagtaaagtaagggaaatcaaaaaatttttcttgactactttgactttactgggtatatcacatacattaatagattctgatagcacttcagttttttgttgttttctccgtgttgcagctaaaacattggggctcagttgacttaagaaatttgcccaatgtcgtataactagccagttttaagtttgtcctaaggtatctgactccaaaccctttgtgcttttctttctgccagtgtacagtattccaatgagtgctaattaagcatttaaatagcaagaaaagcaaataaaaaaaagatggcgtactttcagtaatttaagtaaatctgggaaatactatatattatatccctgttgggagataattctccctggatctcatatgtttctataaagtctgagtcttatgagcaaaagcatttatagtcaatttaagactgtataaggaggcattccagaatagtagaggcacttttctcccctcttaaagagactcgctcgtatgcttgtattcctgggtactacagataatatctctctctgtagggcaagatagatgggtttgctagctgtgttgtaataagattgggaatttcctaagctcagtgttctcagatgtaacctagacccctttgtgcacagcatcctttgggtcctctgcatatcacccccaggggacttgaggagcagcggggaaccagtgaaagcgcagagctcaggatgcctcctgtgatgaaaataacaaactgtctaaatctatttgagctcactggctccttaccagccaaatctgtggaagtatggaaaccactgcagacacttcccaccatattactgctaagaaactgctttaccatttgacaatcctcctcctaggaattccaaattccaagtgagggctctgagaagacttcagataaggaaacccattgatttttcattttacctaatgtaacttgttttcctctcttggatattaataggaaatgcagctccacagagacagaaagccaggcagccaagccagtgtggggtctctgaaataacactgtgctagctgctactttccctgtctcatttgaagattcactctcccccgtctaagcacacccagaagaaattcatgaagcagatgctacgcctctgagtcactgcttttatttgcttctcctgtatccaccaccttcttagctttaattacatggtttggcacattcttaaggtaaggataaattcataacagagattttctcctcttaaagagcagctctggaggaagccttaagcattagatcaagaatccacttagatgtctatgcctcttctacatcttttcttctgcttactctaattgctatgcagtcctatctaacctctaaaagagtctgactttcttctccctcctgttgcattgcttgatataatggtataaacaactaagaagctgaaataatatgatgtgaactttcctaaaagccagtctgagaattctgcaataggagctactaagtaataaaaaagaactcagctggaaatatactttgaaaaaataaattggaagatggctttaaatgcttttgagtagtcccatggaatataaaaggaagcagaacacagaaaatgataaacaaaactttcaagactgactcaataagtagctcttaaaatagctatgagtttccctcctaacacccagcaggctgccaataaccagacagacaaatcgaacaattaaatgctatgaggcagcatcagaaaagatccataacaacattctgagcagagccttaaccactgcctgaataaaatggtcccaggcacaagaggttgtttctgacctggacaaaacagtgaaaaggctgtgaaatgtattcttttactgagcatctgtgatgtgactgataatctaatgtgttctgggaatgttgagataagagacacagactttttcaaaatgtagggaaggaaacagatgagtaaaatagtcaataaaatatggtccagtaaggttatgatatatatatgtcatatgtcattgggagattgggggaaaaacacttcactcagatgtggggtgtttgaagggctgagtcctcagatgagactttctaggtgaggataaattttccaggttaaaaaaagatcagcaaatagagattctaggaggacgtggtgtgttcaagggcatcaagccatgaaagggctggtgctttgggagataccgcaggccagtctggctggagtgctgaaaacatgtgaggacagattgtgaaatgactctggagcttgaaaagaggtaaaatcatgaaaggccttttgtgtcacgctaagggacttggatttcatcctgagagtgaagaagaaaccactgacacgatttatagtcaggtctcactctttttctttttcctcttatggccttcagcgggcgctaacactggttggcagaatggccaattcataatttatagatcaaagtatgtacttctcacaaaatgaattcaaaagtgattaactttttcaatatactgtgttatcacatcctgacttaatttgtttttctcctggtttaaagtatgtttctggatgtacaaagtaaatctttgcattttacaaagatttttttttaaagccaatataaggagacttcgtggtctattatatatgataataagttccaattggaaagaatctggtagtgttaataaagaatccttaaaaccaaagaagggaccatgtttaatgggaacatttataatgcacatatcccagtagcaattagaatgggggagggagaatcagcaacagatccatgagaatttggcatatgtggcctctagctttacataggctgatagattttcagtcaagcttgaatatggaagtcttgaaaactctttcctccatcctctgtttcctagagattactctttcaagtgatctcatcattgtcagcctctctgataagatcctagaccctggctgcagtttgactccagagtactctttcctttatattatctccacagacctggctcttttgcagaaagaaatttttaaatttgggacactgaaaagagcacatcaaatactgaaaactgtttcatgaggatcaaaagcttgctctctttatgcagctacttttggtaaatactgcttaaatagttactaggaagtcttcaactgtattactaaatgatattgcagtgaacatcaaaaatgggaggatagttcatttaatctgaaaagctgcatatttttatattatgtatactgcagtgcttgacatagctcactgtttttcatttccttgcaactgctggcctcttaaattgccttttttttttttttttatcatgtttctgttacattcaggctctttcttgctgagttattttgaaaaaaaaaagaaaaaacagttttgatctcaaaggtactgatattaagatttatccatacaattaaaaaattttaaatgtaggcctagaaagacattagaattgttccagactttttatagcatcaaatttcctcaagtctctaccattgcttaaatttgtcacccagctaatgtgtatgaggtcagtaaaatggaagtactggcatttctatttgatgaaaagttctatttaattaattatatttgtccccatgaagcctaataatgcatcaagattgaaaaaaattatatgtatacaaatatataaagaagataaatttataatatttattttgggttagaacacaatgttgccccatataaataacattttgatgtgttaagaaagaaagaaaacaacagttaaataaaccaccagttagattgagtgggaaagtgtttccttcctatacctacctatgcatttaatattttggcttaaatttgcaatttatgaatgcaattttagagaaggaaaaaacttcatttatactgagtatggtaagaatgttgtggggaaaattctagttattgtgaccttgaggggttaggctattgtaatatgccacatattacatatgccactctgtgtacagtgtagcagtagaattccagcttttgaatgaacatggtttcaaatgattggtccatattggggccatcatttcaatcaggaattaccagctctgtatattccaaaggttatgagggggcctgtaacatggcacattttcattttttcttctgattcttattctttcagaagtagctaccttttgaccattatcaatttttaaaaattgtactttgcacgtttaatccatttttaaccatacaataattacactcgtgtggtggtaaaattatgtgtcgttggggaatgcatataaaaacttgatgttaaacataccatagattcactcaattttttgatgggaaattttctgagcaaaagctgtctaaaaatggttctgatatatcccaaagaggttatgaattgcatcatttacctaattaatttattcactcttgctcattcattctgtaagtgagcattatgtgaacaaagaggcactactagggcacaagtacaacaaatacgagagatggagccacgagcatatgcttcaggcattgtggccgaggacaggcttcaaaagacactcctactacagtcggaaaaatctgagatcaattataagtaacatgcattgtattttagaacttttctgatatttcaaaagagaaaagaaattttccaacggcctaaacacacaataattagctaaaacttaaaataataatataatatcgaacaatttggaaattccagcttactgtggtgcatttattgctatcagtgctgagactgggaagctaacttgggaacttcattgaaaatattggaaatgaaactgagactcttacatttgattcagatctacaaaggctaggatagtttcatgtcagtaacaacctctggctccaagcataagtaataaaaaaatcctaactggaggaaatcttattcttttttgcctctcaggggtcatacagattaaactcaatcaaatgtgagttcacattaaaactcaaagcaataaatgtaatatgtaaaccaccatgagtgagtgtttgcagaaataagaaacgtatttagactctcaaggacttaagaaattaaaattattatatacagaatataaaataatatatgaaaagatcaaagaaataaaagctaaaacacaaaaatgagcatggaataaaaaattattttaaataattaaacagatttggaaaagacctaaatggaactctcagaaaccatcatcactgaaactaaaaattctatgagttactgcactcccatttcatcagctaaaataaaaaataaaaataataccaaacgttttgcaaggattaagagaccctggatttcttagacatttctggtgggaatttaaaatgatacagctactctggaaaaaagtcttcatcttcttgtaaaattaaatatgcaattactatttgaaacccagcaatcacattcttggacatttattccagagaaatgaacttttattcacacaaaaacctgcctcctaacatttatagcatttttttttactggaaacaacccaaatatcctccagtgggtgaatggttaacaggttccaatgcattcacacaatggaatactactcagcaataaaaaggaacaaacttttgctataagcaataacctggatggattgtaagagctttacacttagtgaaaaagtcaaatttcaaaatattacaaattgtataatttcatttatgtaacactcttgaaataacaataatataaaaacctgtagatatggagaacaaattaatagttgccaggggggcagagataggggtaggatttgaatataggtagagttctttcctatgatgacactgttctgcatcctgattgcagtggtagtaacatgaatgaagttaggctgaaactgcatagcaccacagacacacacacacgcacacacatacacacacgagagagagagagaaatggactcaggtaaaaatggtgaacagtgaataatgtcagttatctatttaacagtgtgcaaatgtcaatttcctagagcgaaactagtgaaaatttcatgggactctgagtacttttgttgcaacttcccatggatctaaaactacatcaaaactagaaaaaaaaaaaaaaaaagcttaaagctaaaattaaaaaacaacaacaacacaccgaagtatcaagaccatagttagacagccaatgctcaggtaggataaaagcaaaaaaaaaaaaaaaaaaaaaaagttttaaactgaaagagtgaaagatagatttgaaggaaatagccaaaaataaagatatataatatatatatataaatatataatatagaaatatataatatgaaagtggtgctaagagacacgaatgatagaataaaaaggtctaacatagacctaattgatgaatggaggagaggcgaaattttaaaaaatagtaatttatagtaccaaaaaatgatgaatgatatgaatccacagataggagtattaaaaggatgcccatgatgtagacatgttatagaaaaagtagaacaccaaaggaaagacagaaagggaaaatactaaaagcattcagagaaaagagagatcacataaaaagccaaatcatttagaccaagggttgctaaagagggctgcacatcataatttccatgaggttcttttgactatcaaatgccatactcaccccggtgaaatcatggtctttgggagtaggcctagacataagaacttttaatactcaccatgtgattccaggggttgagaaccattaatttagcttgtgagtaagcttttctagtaaataggcaagactaccagtggaatactatcttcaaagttctcagagaggccgagcatggtggctcatgcctgtaatcccaacactttgggataccgaggcaggcagatcacctgaggtcaggagtttgaaaccagccaggccaacatgatgaaacctgaaaccccatctctactaaacatagaaaaattagccgggcatggtggtgggtgcctgtaatcccagctacttgggaggctgaagcacaggaatctcttgaacccaggaggtggaggtggcagtgagccgagattgtgccactgcactccaggtcggacgacagaacaaggctctgtctcaaaaaaaaaaaaaaaaaaagttctcagagaaaaaaaaaaatcaatccagaattatataccaagcaaaatgagattgatataaagacattttctggtagataaaagcagagattgtatcacaaaagacttccaccaaaggaatttctaaaggatatattccaaaaggagaaaaatgagattcccaggatgtttgatagttaaatgagaatggtgagtaaagaaattggcaagtgtgtaagcaaatataacaggcattatccttaagaataaatgatcacgacaacaataataatctctgtgtgaggtttagaaatgaatatatgctgaataatgtttcatgtaagtcagaggtggatcagtgttaaagtgttttaaagtactcaaatcatctggatttgaagttggttctctaattttaagggctcgtgttattagattggatcctcctggataagtcaggatactttccccatctcaagggtcgtacccttaatcacatcggcaaagtcctttttgcagtgtcacattttccaggtatctggatgtggatatatttgggagctattattctgcctaccacagggccacctgtcagaaagagagggtcaaattacagaacacaggataatgcaagtgttcccaggatctgtcttaaaggactccaaaatgggcaaggtcgttgtacattcaatatttgataaaatattgaatgttccatattttcatattcagataaatttcactttgtctgaatcagattagtggtagggcaggggctatgagatgatagtggaaatcacatttcagatcctgaatggcattataaggcactttagaagttgacatttattcccaagggcaatggggaacctcttacatatttttatgtatcaagaggaagactaaattaagagtggaatagtagggtcatctctctgcttgctgcttagagaatgcattgacagcataaatctagaggacggaattaagaaatacagtttgaagttttagagtagattaaatgaatgaaggaatcacctgaagaggcacagtggtgtggccgataaaacccaggaatcagaatacttggcttggattagtggctgttttgcagtggatgttgcttgataactgtttgaattctctgagctggtggttaactgttggcaacttgtcatcaactacagggggagtatttgtaccggaaaatctgcaaatgctctcccactcttcccccagagccagaagcctccgcaagctagtggtggtgtgatattgaaaaaaataaaaccctcaaatcctccatcctcgatacagggaagctagcatcagtgaggctcacttcataaggttgttttaaggttcaaaatgaaaataggtagtatgcatgaggaagcaaggtgatgagaagttgctgaattttgttttgatgcttttgccaagtattgttactagtagggttctataaacagaacctaagtcaaattacctgtttaacaattttcagtaggtcaaatgtgctctcattactagagtatgattcacttggattattacaaatagaaatgtaaatacctatgtaaaagaacatatattcctcatatgcaagtgtatacatatacgtccaggcatgcacacaacacacacacatacacacatacacagggagttaaggtgacatacaaatgtctttttatctttcaagtttatacccaaagacattggaaaagggagacagatgaagatgagaatgtcagtgtcattttcctgaactcattggaaaattaggttttagctctttggccaaaggtgtttgctgactccacgcctgacacagaccgaaacactaactgatctcaatttcaggcaatgctagaaaaccacagttctccccaacatgaacaaagcctaatcccatgtgcacagcaggatggttttaaaagatgccattttgttgttgttgttgttagcaagctgattctaaaagacaaagagaaaaaatagagtaccaaaatacccatgcagggtttcttcccctaaaggcagcagttgtatgggaagcattcctgcctctctggggaagagtgagcccggaagagggatcagggttctaattccatggttcagtgctagctaaggggacctcatacctctagaaggctcctagtaatagcgaaaagggaggatttatatgattgaagagaagaacaataacaacagtactgtggtactattaatttatttttaggaattacattacttttttacattactgtaggaatccatatacatgctagtagtaatacttcaactagatggaaacatgagaaatggggacattcacacaatggtggtaagagagtgaatggatcccaacttttgcaaaataaaaatagcaccgtgccgtaaaaccaaaaatgtgctttctcctttatttagtaatctcagttataggagcttaatttatatttaaagagcaaataaacactaaaggaagacatgatacttgcacatttgtataactggggtggagggagcacatgggctacaaaatgtagaaaaatcttatacatcaagcataattttggccttgaacagtaatgccattgtttagctctgaatttcttttataccttgagtcccgctatagaatttttgctattgttctttcatctgtaggtcccttctctacaaggaataatcaggattccaggaactactcatatactcaaaatttttgaaatgagttttatgtcttggccacatctccttgatatccttcagcaagaaatatgtggttataaaatcaaatgggaaaaaacgactgcaatggtggaaaaggttttattgtcagatacactaaaacactttggatatgaatgttatgtttaattgatataaaagtctaaacacttacccactgtgctgtgattatggccagggtcattcttcagagctaattcatttagaatatgttaagaaaaatcctgtaagcatcagtaattgaggaaaattgaactcttgaacttttgccagatatttggctgtatgcattttatgtgttaactgagaagaagctgacaacttgctacattctgaaatcgtctcagttgagatttgggttgcaggagacattagccattagcccaactgcagggctattcactgtggccgtatcataccagtgctcaggagacagcagtcacacctaagaagtatgtccttcctcacctggactgctctcatagcaaagccacctgaacatccctcgttgttttaccaaccagattcatcatctgcttcctgattcggcaacgagcatcacctgttacctgagggagtccatccttgtaagaataagaaacttgactaagcaaagttagcatgtggttgcgtcttcaaagagcacaaacgatcttgtgaaggcgattgtttggataccaagaaagataaagatctctttctatctttagtgatagcacccataggtgaatagaaggaaggaggctccgtcttagccgggaggaaactcacttgttcaacatcactggaacttctaagttgaagtggaaaagggagcatgtgattttcaacacttccaacacttccaagagtagcatgtttccatagtcatgcataatctcagtctgatttgaggctaagaaaatattaaaagtttccaactcttaaaaagtataggagtcccacggcctggacacatagtaaaacacttaataaacactttagatttttttttccaaggaagcagattacgtcttgaaacaccctttactctcaggccagtatggtacggtcagtaagaggtatcaagtaaaattaattattgaagaaaattcttcattctagagtctaaataatttctcctgagataatctttttccacagttattttattataatgggattaccctaatagtctttgctaaaagagctgagatacataaaattattttttcatagtatagagttctaaatctttatgtccttattttatttattaatattattattaatattattatttttggaaagagagtctcactgtgttttccaggctggagtgcagtggcataatctcggctcactgcaacctctgcctcccagattcaagctattctcctgcctcagcccaccgagtagctgggactacaggtatgcaccaccatgcctcgctaattgttttgcatttttagtagagatggggtctcaccatgttgaccaggctggtctcgaactcctgacctcatgcgatccacccactcggcctaccaaagtgctgggattacaggtgtgagccaccgcacccagccaccttttttattttctttaaaaatcaaaacagaacatatttgacttaggcctttatcagacagagagaaggatgcacatacctaagctggtaaataattatgtcatcctcatttacagtataggaactttctccgtaattattgtactttgaggattaattttccatatctcatgtgtgttccttaagatttccacctcataccttttttttttttcagctaaagcataaatgtattgactcaatctcagtttaagaagtagggtcaacagagccttaggaccatctcctggtggctaaccatgaattgtttcctttcatgatttttttaagcacatgttgagttagatgccaagattctgaaaccagatggagctgactcaatgagcttccatttatgttccagcatgccagcattagctgggttccagcagatacttaagtaatgagatttgagcaacatcttccccaaagtattatcttctttagcctattgtagtttatgaaatttgggggattaaaatctggcttagagagagtaggtcacttcaattctcaaagccttcattttcttatctataaaatgaaaataacaaaacctacttcataaggtctagtaatgattacattagaacatctggtagaagaagccaggcaaagtgactacatgctgtgttatttcttttatgtgacattactgaaaagacaaaaccttaggaaaatattagatccatatttgccagtgattggtagtgggaacagcagactgactaaaaaggggcacaagggaaattcgaggagtgatatgctttttgtctatcttaattgttatggtagttacacaactatttacattgtcaaaactcatcacggacttttagtttatacaaattataactcagcaggcctgactttttaaatgaacactcatcacggacttttagtttatacaaattataactcaacagacctgactttttaaatgaacactcatcacggacttttagtttatacaaattataactcaacaggcctgactttttaaatgaacatatgtaatgggtttcacacacaatgcagactcaataaacaagccctgctcacaacttctctcaaaggagccaagcacaacaggtacttaaattaatgtcctttacattgaaaggtattatataaaaccaaagcaagcattttccatttttaacacatttctaaggcttttgcatttccataaagaaggcagtgatgactcatgatgtgattttaagaatctgaacttactaaggtcccttgaaagtaaccacaaaaaggctagatctaaaatatattaaaatccatatacaattaattgtagagtgattcatatagatacagtctctattttgtattgcttcttttttaaatagttatctgctagtgaacaaaaaaataaatatatactttttgatatttcaaatagatatcaaaaagtatatatttatagcttttgaagtataacttttaaactttatcaaatataaaagtatatattctatttgatatataggtatgtgtatgtatatatgtatatttatttgatatatatgtatttgaatagaaatagaaagtgaatactagtaacctgatggctaagaacgatcacatatttatatgtattcattcaacacatgcactgtgggttgtattctgtgccaggagatgaggatgcagggatgaataaatagtatttctgtcctcaagaagctcatactttatagtgatttagagacatgtatgatgaaattgacactctaatgtgagtctgaacaatttttaggcaagcaaatgctcttcatgcactacattccataaccaacctatgcacagcagtaagtggagtctttggggcttggtttttgttaccacgtttgttacagaatgccatatttggacctatgacaaaaaaaaaagtaatcttaagtcaggcttgcttattggagaataaaatagaatcatgaggtaggagatttggagggactctgttacagtcaaataattttattttaaggaaagcagatttactccttaacactatcttaaaatcaggagaaaatgtaagaaactttcataaaatatttaatatagtttcaaagttgtgagcgtatcactgttcagaagttaactgcaaaacagagatgactatatttgccataattatcaataatgatgtatatatatatatatactctatagttacactgggatgagcattaatggattggtaatgaatgaacaacagcaatgattcaacaacattagttggctaaagcttcacaagaataaggaaaacacagcaggaaccttatagaggtaagtgaagcatgaaattcagttacgtctttgacctaatagcattaggtcaaagcctttcaactttatctctttactaattatggaacgaaccctgtttaaactcttcataccatataattctctaagcaattcttagtggtagttattattattcacattttagcgatgagaaaattgaaatccagatagatcaagtgacttatctaagataacccaaccagtaagtggcagagatggaatttgacctcagccaatctgggtcctggtccccacccttgactctgtatgatacagtgttacaacaagagcatgggtagagatgcaattagaaggtaagaattatatctgcaaaatcttgattagtcctaacaataataatgtagtcactactgttaacccaacttgatgcaggctaatagctaaaggtcataaagtgtccaaagaaagatttagtagtaagtacaatatcccaggagaatctacctccagagtgcaagtcgttatactactcaagttgatatcttccaatgtaggtgtctaaaagccctttctagttctgaatttcactgattctaaaagggagtttgtggttagtatagctggtgggggtagacttacattgctgccaagtgcagaaatacactaaagccatgcacagcaactcaagggtcagcatttttgtcccacttctgggcatcctgaaaatcctttcttctttgagcttcctcaaaatcttgtataaactgggcttaaactaggtagatctcagctggagggaaagttctagcaggctgaggaagcctagaaagtttgcattctctaagcaatgttagcatgaactctttgtactcattacttcttagtatatggcagcagcttcagaaaggtgagtcaggaaacattcacattcccaacaattagaatgtcaccactctttgttcattcttttgaattatagtcaagaagtgtcttattaattcaacacaatgcataaatatatcttgagtatctccaatgaatcatgtactgttcaagcctctggcaatacaaacaataaaagacactcctacgtctcaaggaactatcactttgggtgacagagagagacatctaaacaaatatacttacaatgttggtaatacattcatggaggcacatgggaaggacccagaagcagaggaggttcactgtgcttggatgcagatagcaggagttaatatggaagaagtcaagaatgtcttcccagagatggtgaaaaacaaaatgagttttgaagatatgatgggaaaatacactgatttttagatatagctctagataaaaataaagagacaaagtgttacaggtaaaattagctgcagatacatcttagttgtcatgtagttgatccaattgagtgaacaattgaacaacaattagaacacaaacaaacctccatgatctgaggcctgctgaactctcttttctgacagcccttcccactgcacattggatatagaatgatgccatggcattccatgcatccatgcctttgaacacactatctcctctgcttgaatgacctttgctgcttatgtagaaggaaaaaacagttacattcatacctaaggttccagagcttccaagaccttgtcaaagaaaatagactcctagcttttctctactgaatgcaatctccgttatcaggccataagctccttaggagctagcgctagatctgagtgaacactgccagtagtgtgatgaatttggcttttataggctcaaaagaaatattgttaaatgtacaacattttttgagccatttgttaaatttttggcagcttgaagtcatctatggtgggagctgacaaacactacattaaaaaaagatcaaaaaatttgttggataaattacattagagtaatttttaaagtcacatattcaagttgtagtgatttaaattaaataaagttagtgcagattataagaattgatgagtattgaattgatgagtattggaaaaggggatgagtggagacacctctctgagcagtgtgagttttgaaaaggaaatcaaattattagagaagataatggtagccaaaaagactttctaaggatcagtgttctcataattaaaaaaaagaaggcataagaatttctgccaaacatactttttcaaaaataaaaaagatatatgaaaatgttttataaaccatgtagtacataactatataatatatacattatatagtgtatagttgcaattattggactaaaagcagttaatacaggctttacatatgttaagacttttattcagaagtaaatgaaatgtactctttgagaatgggtatattttattgttttttataaccatattctcatttatttttgaaactcttcttagaataagaaaagagtacaggaagaccaacaagtcacattcaaaccttataattctgcagcctaggaaacactgtcttgtgctggaaatggcttcctttcttcctggtccaacttttttgaactgcccatggattttgcactgtacaaatcacaatccttagaaatatattacccacatacatttctgaagagggttttcagggcccttttttgagtattacttttggatatattattcctactaaattatatttcttccagaaaaagttttgaaaagttggcaacctccctatttcagtccttcatattatgccacttgttacagtcataaacagcaaggaaagaaggaagtttgaccaaatgcaaatggctgggaagaagtagccctttcagagttgctgaatgtctcgtgtgaaaatgctttgtggctgagcttaagaaataaatataaagtagtatttaaatcctcatctcaaagcttctatcagtaatagatatgaagcccaaagcagtaaatgtttaaatgactactttacatctcttaaatgcagtgttatgtcctggctatatggtaatgacatcattaaacagaaatcctttgagccgcagaaccaagatgctttatagtaagttctatgaagttacatagtcaaagagttcactgttctttaagttagactcatatccgcaattttatgacaggttctgcttaaataattgtagggtagtggtaaagcatggactttagggtcaataatctgaagatctaaatttgaatttgtcgtgtctttcattagttagctgacattctggatttcagtttcaagacctttaaaatgggaataatagcaatcatcttaaacatgtccaagaaagagtgagacaattaaataaatacattactaagaagggctataaatgaaatgttattataggtattagcatcatcattatcattcattaccctaatcattatcatctttaagcaatattaagggatgacacttacagatagactgagtcttactctctgggtcaagaaggttatttcaaaatgcaagttactaaagtatattatatatgcaaaacatttggcttattaaaactcaagtgtcatggctcatagccgagacctgcactttcatataaatgtgatttgatcatatgtatcatattcaaaaatatctattagtcctataacgttagccacagtggctaatttctataatagcttcacattttagttacttaccaacataaatatttatttcttatttatgttacagtaaacttaagtttgcttgggtggaaggttgtctctttttcacgcaattatttagagttccaggcttcatccatctaatggctttgttaaagtctagagtcttggagtgtaccactgactccgttaatctgaccggcagataaaatagtaaagaaatcatggaagcttgcaaggaaagtacatgaaccaggcctggaagtggtatataccacttccatgaaaaatcctactggtttaaaatcggtcgcatgactgcacctaattgcaaaggaagccagaaaatgtagtccacctatatgctctgatggaagataaaatggatttgatgagtcttgccagcctctgccatagggttctagcatattacaataaattatgaatttaattgaccgaaagacaaagcgcaacttaatggtgtcacaatcccatgttagttataaaaaataatgtataatctattctcccctttatggttactgtaaaaattagtagcaccctagttaattcaatgccagaaagcagctgtcttgagagttcatggtcttaagctttacatgcctgggctctatttttggtccagtggagttggtacctctggggcctgagtaatcccgtgttgcagcagacagagttcctctgctgcagtcaggccttctcatcagtgtatacccctgtgaaacttccagactacacagaataacctggctttctctcctggatgtggatgtggacactaaatgctcttcatctgaacgaagaggtttgtgtttcataaagattaagctaactatgaggaaaaaacaggcaaccagactcttctgagattttctgtctgcatatagacatcaatataaacataggtatatgtttgttcagtatggcttttattattaacagaacaagagccagctccctgagagctacccaaggtcctaaaccacctctgatcaaagttatctcatatctagggtagcagaggactcctgatttttcagaggacctattcccgtcatatcttataaaatgtaatgattgacttcttacatacaagctgctaattttgatatggtctaagctgatatcagtttacgctgaggactttttcatatcccaacataacttgacctttcatcccatttgattgcatggtctgttcatgaccagccctgacctgtgataaccctcctttataatattctggtgttaaggatgcccaaccttgcgctaaagtaacctgatagacccagaaatgctgccagtacagctattttatcaggtgggatttagatatttatgcttctgtgatcatgtttatcaaaaattccaaaaacattttctcatgaggataacataagaaaggagggaaggggctgagcacggtggctcacgcctgtcatcccagcactttgggaggccaaggcgggcggatcacgaggtcaggagatcgagaccatcctggctaacatggtgaaaccccatctctactaaaaatacaaaaaataagccgggtgtggtggtggtcgcctgtagtcccagctactcgggaggctgaggcaggagaatggtgtgaacccgggaggcgtagcttgcagtgagccgagattgcaccactgcactccagcctgggtgacaaagcgagactgcgtctcaaaaaagaaaggagggaaaggagggaaggaaaagagggatgattgattttccctgccttactcacaggatcaaatatgataatgcagacaaaactgttgtgatgatatagagtatttttgtcatctaactcatctaactccatcaaataataggatagcttggttttgagaaaacaagtgacaaattatcatacttatttttctcatgaaatatccttcatgtgtgatctttatattctttggaaaatctaaaagacttacagttagtcaaagtaagcaccaacctaagttccaatctaatttcagaagtctgaatcattattttaattctttagggtactggaaggaatttaggttcaagatagctgtgaacaatgtgtttatatagtaaaacaagatttatttatttgttatcactaaattccatttaaattttacaatagctattattacaataacacactattaaattacaactgcatttatgtagatacaacattcctcaaaaatgttgtttggtatttaaagggcattattatgattatcagaaagaaattttgttaaattgcatttaagatatcttaaatgtttatctagttgattggttgatttattgacatgagtagaatattttaaattagtaggctacctagttaaattaatgaatttttatctttagtatcatgaatgaaaatgttgcacatgttgagaatgaatatgagacagtctttaagtcaagagcattacaatctgattgggaagattattctattgaatatcatttgtcagttactgtgaatagaatggtgaatgagacatttaatttgcatgtacttgtcatatctttcctactaggatataagcttcaagtttcagaagatgagaaatgtgtttaacatctccctctctctctttttgtacagctcttgattgtcacaaagtccgatgtgcttgtagttagcaaaaatagttggataagataaataaatgaatgaataaatacacaataacattttgtagagaggatgtaatagatcctaggaacttccatttaacctgtgaaatctctccacacatacagttcagaggcaaaatgttctggttttctaaatcctcgtgatcacatcactgttgtcagtttgccttaaagaaaaagttggaaaagctcatagaggctagttgcttttagctgtgaatctccaaatacttgaacatttcagaatgaagccaaacactgtttaaaatatcagcaagtggttatccatggatggtgggattcacggcttaatgtttgtttatgttttcatttatttattattcttttgcagaggggcacagatagatccattatttgtgacacatggtacaggcatttgaaaagattcattgatagcaacatcacagcaagtaatacagaagtccatattgtttttccatcaagagttatgctgaaactagcagagcttatgctatgaaaagccccctggtagagaacctcttcaccctaacagcctacatatgtgggaaagggaagcagggcatatctagatgagtatataattgggggagcatcttgagaaagacaatgatctttttcaaaagggccaagcctcgtgatctcagcctctggtatctgcctgttcttccaatgagttctctcaggtctgcagagctagctgcttgctcatttattgaaaaggactggaaggagcgtccagggccatctgcatttgtctctcctcacatgcatcttctaaattttccacaatcatcatgttcgtaataaaaacatataaggtgttttttgtttttacaaggtaaattaaattgtgtatgatattttttattctttaaatgtcgtacacaaatgcatcatcgcactttagccttaattggccaaccctgggtattatcctgactaacaatggaagaaattaaagaatcatgagtcttcaaagtcagcttttgaagccagcctcaacctacttaattacagttgtgcgtgtgtgtgcatgtacgttgcatattttttaatggaatcttcatactagtcatgagaatggatagtcttctatttttcttttaattttgcgtataaggagagatggagattatgatagaataaacaagttgctgaatgaaggacacacagttaagaagtgacttagtcttacctccagtgaaacctgtggaatatatatatatatatatggaatatatatacacatatatgtatactgaactttgcaacaatttacttgatttacatttggctcttttacaaaaagtcagagtgagaaagagaaaattccatagaattagaatattctaattctaatttatacaaactatcatgggtttatagcatctgaaggcacccatttgagtaggggggtgttacattgactaatattgacctatttctgagaagacatgaaagttaaagggtcaattgagtgttgttgttttcaagaccagtttagctcctcttttcattttatagtcacatttaggaattcatagcattcaaagccatgataaacagattatgcaaaagtaagtaagtggatagtgactatagttgcattttatgttaactgcatccttaaaataaacattagcatatcacagcttttctagagaataatttcagtgatttcaaattagcttgtttcagtaatttcacataatgcaacccacagagtgcagtgaaaagaacagagtgaggaccaccagacctcagcttaaaaacactcctcagctttttgttacaaaaagaggcaggtagtgtaattcttccttgtaatttctaccattcagtgcctatgtaataataaaatgagaaagaattgatagaatatgctaatccaaaaacataaaccattatctttataaggaaaattaaaatacagattagaaacaaaaaatatctctgaacaaagtcattaaaattaaaaactaatttaacaagggtttaaagatatgtaatgatatagtataaaagctaaattaaagtatctaaaagtaaacaagtgttgaaaagatctgtaactcacttattggaaatataaaactgcatcaaagcgaaaatagtgtaaatagctaatagaaaaaggaaaggtgcttaaagaaatgtaacctagaaacaaatgataaataaaatgacagcaaatatgcatcagaattaaaatacaaacaaaaatagttgaaattcgaaggtaactattttctgtactttccatctcttaacacattttcaccctctgtagggtcaaagacagaacagatataagaagagtgcgttaaaacaatttacctgttctcatagagacaggaaacagttattaaataactaaacatataaacataaaatatttgcattttatacttgttttatgtaacttaaactgtttcccatctgcctggcatggtggcgcacatctgtaattccagcactttgacaggccaagaagggcagatcatttgagcccaggagtttgagaccagcctggacaacatgacgaaaacccatctctaaaaatgcaaaaattagccgggtgaggtggcgcacacctgtgatcccagctacttggagggctgaggtgggaggattgcttgagcccaggaggtctaggctgcagtgagctgtgtttgcgtcactgcactccagtctgggtgacagaataagacgctctctctctctcctccctccccctatatatattccccatcctacctcttgctctagtcactgctgtagtgatcagtttttcccctagacagagcctccttttgtgctctgtaaatcctccaatgacccatttctgcctcctgccttggggtttctgtaaggctgtggcaagtaatgccagaaaaacctgacctgcgcatgtacaaccaaaaccagaagcacaagggagttaatgcctgtgaggctatccttgagcagtgggggttgggacctgatgtgaaaaatctgaaatatagtatatgcaggttcacagaagtcccattgggatcaagaacctcctgtagtgtcgactaacctgatcaaataacactattttggctttcttcccattcatttttgactccctcagctatcactcactttatagataaagttcagagttcaaacaagttatgtaacttactcaaggtcaccctatttgtaagaaacaacagcatctgtcctcaatgccttcctttagaactgaaggcacttaaaaatattttctacttttacctctttaaaaagaggtaggtttaaaaacctgccttctgttctttctccccattcagtgacttcaaggtatgcatgcccctgtctgatgtgaagatgtcactggcgactgcctattacataaaaccttctcaaatatgttcctataaaaaatattattccagagagcacatggttgatccaaacgggctaatctctaatgctggaattctaggtttctttgttcctgaaattggtcaagtcttttccccccaatatccataaccataatatgcagtttgtcactcagggaactccacacaggcacctatcacagtttcctggtaataaaaattaagaatatagttgctcccatcttgggttggtttcaagtacatcaatagaacaacttatagaactgtcatattttagagaaaattgcagaaagcagtgtttccagtcatttgctaactgagctagaaattataatggcatgccaaattagactgagctgtaaaaggaagatattcacattactcttctctgccctcacagtatgcataagacactgagaggcctgcaattcttattctcttaactaaacgtttttcaagtcttccccattctgggtgttgtattttgctccatttattttgccttgcatccagtcaccttgcagctgtaataacttgttggctctctagggaaagtggggttggagtcctttctggtcaccggatggttgaaggatgtgcacggctgaactgtttacccacacctcatccctcctcctgttctatttttgagaactgtgtgtttcataattttaataaaaatagagatcacactgtttatttggcagaggcgatgagaatagggcatgctttgctggattttttttttttcttgaaattttccttctcacactgctgcccggtctaaggtgagaagtggctgtttctatgtcttactgtcttaggtgtccctctgcctgctgtcacataagctgtttctggcagctctgcctgtgaccaattctgctgtctcctgctgggaggctgacacctaactggaccctttgttttccagagtggaaagaacctggtttatgcaggcaagaagatagtatcctgagaatgaaaagttagatactgtctttgagccatgtgaagtgcaaaaagacacaaacagtgaacagctcgttaaattaggaaatctaaaacacaggcctcaaatgagaagcatttgtgtccccaaatctcaactcctatgctcaggagtttcactgaagatttactgtagaggcaatgtagaggggccctgggagtttaacaatgaatataatgtagccccaccctggaaacagacagtctaagggggagctgaagactttgtacaatagattttaaattcagaatttattgtattttattaattagttttggggtctagttattccacgttaacctgtaaaagttgccttgaactataaagaggttaaataaacaactaagaggagtaacataaaatctgtattctggcagcaatggaaatgtggaagaaggtaatcacattttcttttcctgacctccagaccaagaagtaagatttaaaaatggcttgtttcagcacacacagccccgttttcattttcacctatctctggccttcttatgccaatacctcgtgcccagatactcctatttggagaacaagagcagcagcttaatcagataaaagtaatatttttcttcttctttctagcaaaacttagattctcatagagcagagtctctcagctgtgtattagggaagaaatcaactgattaagctaaattattctatagtgtgaatgactgatagaatttttgttctagaaacattagtgttttaaatataagccttcctttaactatttaccttaatgatttgtgtttggtgcaacttacttctttagaaggacacatattctcaaggactcctaaaaacacatctttgcaccctccagggtaggagaataatggatggagaaacattgctctgcctcagtgattttcgagaagcgagagaaaggtgtctgcccagatggtgaggcattttgaaatggagccatggtgtattttgaaaagaattacagcaatactgaagtgtaacatcgtgtgtagaaaatgaagcacagatatccacaattctacgatccagattctctaaagtaaaattttactttaaaaagtcattgtgaatatgtaaaaaatacagaaattatcaggtagaaaaatgtctcattaggagctcatccagaacctccaggtgttttaatcgtattaaaagtaatataaaccagtattgagcactgatctggttactggtaatttagttcatatcaaagtgaagtaaagcaaataagcaaaacaaccaaagcagtgtggtgttctggtcaaaaaagccacctgggccagcgctggctgggcctctggaaaattgggaatccatgggctctccatcattgtatagctgctgccctcaaccattctaatcacacaattggaacaatcccgacccctcccctggtgtccacggtgcttattccgcagcatattgagcctctctgtgccagacacggttttaggaactggggatacatcctcctctctctcatggggttcacatttgaaccacaggagacagacaaaaaggagtgtcagatgctgatacgcattgggaagaaaacttaagaaacagtgatgtcatagaaaatgactggggtagggtaggggattattttatttggctggtggttggagaactctgaagaggtaacatctgagcccaggttaaatgacaagtttccagccttgcaaatatcagaagaaagagcattcctggcagagagaacatcaagtgcaaaaccatgggggcaggaatgagtttagcctgttttagaaacggagagaaagccagtgtgaaccttggagtgtgaccctggagagacaggcaaaacgtggaagccatagagcttcctaatccctggttgggaaactcattttacttccaaatgcattggaaagccctggagaattttgagcagggaggtaagaacagtttatcatttttaagtataccttttataataagttaaatgctaataaaccaatgactgcttgaatattatttggattccttgagagaacacatggctaaagaacagacctgtcttgctgctctctaaagcaatgaagctgatggaaaactcagctttgctgttcagcacaccgtcaccatgccaccctttacgtgccttgagccaatgtgtgtatgtgcctctaagacttctgagaccaaaacctctctttctgcctacttagcatgcacaccacaattcctctgaagtgtctgggggctacccgctttgctgtgatcttcttttagtgtattttaatggattttagaagagtgttaaatctctgctttgtaaagccttattcctatcctcaaattatctaaattcattaccttcttgctataatagtttaattgagtataggatacaaagctaatttatttcacatttttgcttttaatagttttcacttttcttattgaaaaagtaattactgaattccaatacaataactggaaatgacttttctaataacacatattatcatgtcatcatcagaagaaaattctttgaagtaccctcaaggtagaaagccctccatatgtgttttctatgttcatatatacatatatgagtgcattttaatgatgtgctgatattctattattttgcatgtactataattaaattgaactatataaaaaatgactttttagatcatagataatcaaatacttgtttatggttcaatctaatgtaacaattttcctacattttaatattttgtttttaatttttaatatcgagaaatgccatttatactcatcctatgtttatctaaatatatgtatataaattatacttgcacactagcctagtaatttctttagaataaattctcagtagttgaattattgcacatggaaaagaacatgtacatttttttttttttccttgagacggagtctcactctgtcaccaggctggagtgcagtggcacaatctcagctcactgcaacttctgcctcctgagttcaagtgattctcctgcctcagcctcccgagtagctgggactacaggcgcccaccaccacgcccggctaattttttttgtatttttagtagagacggggtttcaccatgttggccaggagaacatgtacatttctaatgcatatatttccaaatttatcttaaacttgtttatacaatagtattataagtagtaatactggatatgattgttttaattttggccgatcttttaggtagagaaaaaaagtttactttcgtgtgcatttccttgacttaccaattaaagcacttgagcattttttataatatttttccaccacacctgtcccttcaatcttttttaacggcatcctctcacatgctgccattaattcatgtactgtgtttagcaagcaaagcattttcaggtgggggtcattcctgaggataataaagtggatgaagtaggttccatgggatgatgatatcaactccaagggttaaaaaggttcaccattatatctttggaaaattagcttgcagtttgagatttgctaaaagccagcccacaagatgaacttcaccaggctcttgtctaaatgcccatcagagacattctggaaatactgtttactgggttaaggcgttaagacatctgggttaagcgccatcactgggatagtttttctgaaaaacccaaaaacatttatgatcttctatacaaaagcaaaaacttaacaaatacatgctctcttaccagagtaacaggggaatatattttatgcctgactagagctttgcaaggttaaatagggaagaaagataaagaaaaagaacaagaactatttcccgagcaatatgagaaaacgctggcatgttggagtttagtcccatgaactcattcacagatggggccctctgtccctctctcataatcaagaaagtgatcaggaatggagaataaatgattgattctagaactgtggaggagttcacttctcagaatgcggtttctgagccagtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttagctagtgttatggctgttattattgtcagcatctttgtcctttgtcaagtaattggactactaaaggaaacagtacatattagagaagaatattgtgctaataagtgtgaggtatgattatataaggccaccttaattactgcaagaaaaggaagagaaaaagttgtcactttaaaaagctcagcaacagaatatcccgcatcagcacttagtggatatgcttgccattaaagccatggtgtggaattcctgattactcagcttttgcaaattgaaagaataataaatagcacaaaaaggaaaatggttacttcttctaagatgtatagaaacaaacatctaattttcatgttatgcttgtttaattaggtaatttactgtaacatatatttatcagacaagagtacagataagatgaggctctttttccctttatatcatattatgagtattaatttatactgcacaaaggacttactgattcttttcatgcgcgtccgtgtgaagaggccaccaaacaggctttgtgtgagcaacatggctgtgtatttcacctgggtgcaggcgggctgagtccgaaaagagagtccgcaaagggagataaaggtggggccgttttataggatttgggtaggtaaaggaaaattacagtcaaagggggtttgttctctggcgggcaggagtgggggttcgcaaggtgctcagtgggggtgctttttgagccaggatgagccaggaaaagaactttcacaaggtactgtcatcagttaaggcaaggaccggccatttatacttcttttgtggtggaatgtcatcagttaaggtggggcagggcgtattcacttcttttgtgattcttcagttacttcaggccatctgggcgaatacgtgcaggtcacaggggatgcgatggcttggcttgggctcagaggcctgacaattctcacataatgatgttggtgattgagatttacaggcaaaagacaaaagtgtgactatagaatataagaaaaaaaagaaggggagaaagtatatatttaagaagaatgaagtgtaacactaagagacataaaaccactattctggtataaaatatagtagccaattccatattctgggagtaaagaaataaattcaaatgttaggtcataccaaacagcaaagaaggcttgtacatgtgacctaccctttctgggacttaatttctccatttctgaatagagaagccaggatcaaatacagatcacctgagaaacagtggagaagctcaatattgccatgttttgtttcaggcataggctttggagtcaggtcaactttcatctgctttgcccactgaactagcgctgtagacttgatcaaattaacttatttgcatattaataaacaaatgaatgctggaatgagtagaggaaatagtgctttgattaatttctagaaatctgcctgtctcactcaggagctgctgggtgtggaaaatgaagagaggaagtaagcgtagtgttgagttttcccaatttgtcgctcttctgaagctctctttttcacttttcgcttgggctttcacgtaaaagttggtttgaaaataagttttctctggaaaaaaaaaatcttatgtaagaagtcttcaaccttcttaaacatgacagccatccacctttattggggagaggtaggtgactgtagattgctgaatagacactgtggcttgtgttaatgactcatgaacatagttaacagggaacaaaaaggacagtgagtatttaagtggaagaaaacatcagaaacttgctactccattccaatatacataggaggtgggcatatttaatggaaaatgcaaacacgtttagcattatgactatgatttagaatgttaggaaacaatttctctgataaaatgctatatatctgtatattctaaatagttgtatcactgaatcagccttcgcacttttcttctagcatttgatggcacccaaccacgtcttcaagttgttatgcctgttttcatttctttatgagacacgaatgttggcaaaagaaattgacaattttaaattgacatagcctgtttccttggaattttagaaaattttaacctgtattgcgaattgagatttatctttggcttatatgttttttatcatagcctatgaaataaaatctattattattaatattatgaataaataaacagaaaatctttaagatagtgcatcggtgtgggaatataacgcatggagcaccatttgaacttgatgaatattagcaagtaacacaaaggttcataatggctgataatgcaggtggtaaaatgactcattttatgttatacataaggcacccctctgaagtatacccactttggaaagatacacacaatcgaattagctaagaaacctccaaatatctttctaggatttttcatctctagaaaaagtcagatattcctaagagggaaataagtagaactattctacaaaaaatagttaacacagcaggcctgagtcggatatcttcaagcctgcttgcaaggttggcccttggctgccatctgggaacatgtattttgagatagtccccatttttctctgataagaatgcctcattgcacctaaactgtttacacaaacaatattgtttaggctgaatacctactttcctctaggtatctagaattttggtagtcaaagttgggtggcaggggtgcctatgtgaccagccaccaataaaacacctgagctctcagctctaatgagcttccctagtagacaatattgtattcatgtcagaaatatttctggaacaattaagtgtgtcatatgcgatcccactgggagaggattcttagaagcttgtacctattttctttggacttcattccatgtgacttctccccttgctgattttgcttttcatcctttcactgtaataactcatagccatgaacaggactatcaaacttgggcttggtcttgtggaccaccaaggcaactgtattattgtgtgtgtgtgtgtgtgtgtgtgtgtgtgtgtgtgtgtgtttctattaatatcgttgtttatttgatgctcatattttcccagttttatcagtagaagcccctccaaggcagttcccatatccttttgacagattcccttaatttttttatgttatttgattttttaaaattatactttaagttctgggatacatgtgcagaacgtgaagccttgtcacataggtacacacgtgccatggtggttcactgcacccatcaacctgtcatctacattaggtatttctcctaatgctatccctcctctagtcccccacccccagacaagccccagtgcgtgatgttcccctccctgtgtccatgtgttctcattgttcaactcccacttatgagtgaggacatgtggtgtttggttttctgttctcgtgttagtttgctgagaatgatggtttccagttacatccatgtctctgcaaaggacatgaactcatccttttttatggctgtttttaaaatgttcacctaaaaaacagatattaatcaattgcccactgtgtatcagacagtgttctggttactggggatacagcagtgtttaaaacagaaaattcctctgccaaaactagaagatgtcatagttagtcttaatagaatgctataatgtcctaaatattgtttaggctcaaagcgcctactttggccatcggcaaattagaattatatcagcaaattaacaagatatcccctaaaatacccttgatgcatgcggagacttcctctatccatttcttataccatgttgaccccctcattctccctccccttggtgccaatttattatgaccacactatgtaatgttgcatgaattgttttgtaattactctctagtgcttcaagtgggtatatttcatcttcccagtaagtagagagcaaatacaatacctcttttatgggttattttcatcctaaggttgctcagtctggtgtcctgcagacaaagtgtgctttcaaacatttgataattttttaatgtatccaatgctctgaaactattgctgcatttctgtctttgagcatgacttttttttacctgatagccacaacaagttcatattatgttttacttttggattttcccaaaagagctatgactagaggatagcatttccacctggggctttgtctgacttgtccatgactggtaattacagtttttgtctagatgtgacttttggtccagtctctgagcctccagcaaaccatacatcttcgataagccatgatgcttagagaactcattgtttcaatcacacagccatgaaagagaaccaccgacatttgtctcaaatgaaaatggagccaaaattcataggcaaagtcactctcccacagatttcacagaacttagagattcagagaaagcgagggtgttccgttccattgtttttgcttgtttatattttccattgatccaaaaataattttagcctgagaagacaagggagatcagtgagtggcagagacattttgggggtgacgttctggcaagggaattcagactttgagaagctcatcaaaatgatttgggaaagttttgtacccaaattaacaggcaaagtgtgtctttgtcaataataggataatctatttttctactaatcaatacttgagcaaaaattatgatttcaagtactaccttattgttccagcaattctatgccattggttgagaaatgagatgcatccattttagagttgctcctacagaacaatcagtgctttcctgggttatatttataaacgcattctcagttctgtgtcaaaaatacagttttacattattttttcattcgcgttattaaacattatttaacctcagaatgatgaaatggattaataatatgtcaaggaatgatagtgtaagctctcagtacattgcgtgaggcacatatcactattaataatctagaattgtatggcagtcattaatacttttgttttaatcctgtgatgctgtcagattattttgtataccattcgtcttttactttcagggtcatgacttgaaattttttaaacttattctttacggtatattcaggtatttaaaagttcagtagaaatgggatggaaccgttaaaatgtagagctttcctctcttggataaggagacctttttccagaattctaagtgaactgctatggcatgatgaagactagcactctcaggccaggtgcagtggctcacgcctgcaatcccagcactttgggaggctgaggtggagagtttgagaccaacctagccaacatggtgaaaccccacctctactaaaaattaaaaaaaaaaaaaattagcctggcatggtggcaggcatctgtaatcccagccatttgggaggctgaggcaggagaatcgcttgaacctgggaggtggaggtttcagtgagccgagattgtgccattgcactccagcctgggcaacaagagtgaaacgtcatctctggggaaaaaaaaaaaaaggctagtgctctcaatgtgctgagtcttttgtccctgacttaatctaagtatagtgcaccgttctcaattcataagcacagttgacccttgaacaacagagttttgaactatgtgggcccacctatacgcagattttttttcaataaatatatttttaaatgtttagagatttgtgacaatttgaaaaaactcactgatgaaccacatagcctagaaatatcaaaaaataggaagaagttaggtatgtcatgaatgcataaaatgtatgtagatactagtctattttatcatttactaattaccataaaatatacacgaatctattataacaagttaaaaattatcaaaactcatggacacacacttacagaccatgcatggaaccattaacagtagagagaaatgtaaacaaacaggaagatgtaatactaaatcataactgcatacaattaagtagtatgtaactgtactactatagtaattttgtagccacctccagttgctattatggtgagttcaagtgttcctactgtccacttaaaactctgtgtgatgctaatcacctcctcctgagcagtttgtctctccagtaaattgcctagtacagtaaaaagcgatctctcacgattctcacttaattttcactgtatttagtgcaatacagtaaagcttgaataacaccatgagacccatgcaaagtgccactagtgatgctggaagtgctcccaagaagcagagaaatgtcatgacattacaagaaagagttgaatttcttggtatggactgtagattgaggtctgcagatggagttgccaccatttcagacagacaattcattttgtaaacaatgtcaacttatggtatcaataaatacagtactgtactgtaagtctattttttcttccttatgattttaacattttcttttcccttgcttactttattgtaataatatagtatataatatatatataacatacaaaatatgtgttagtcaactgttgatgttactggtaaggcttttggtcaacagtatgctattaatatttaagtttttaggaagttaaaagttgtactcagatttttgactgtgcaggaagggctggttcccctaacttccatgttatttagctgtatagcattatatgcttactgtacatattttgtatacttaccccaataggagcattttgcatgttccttttaggaaagttgtgttgactcataaccataaatggctgtttcctatgtgcaagtgatagattctcttgtgactatttctaacatggcagttcaaccaatttgactttaggtccagtgttttggccagctaaaaacaatgcctgtttaaatgtgtaactgaaggaccagagtctctgtgaagtcaccttctaaaaattaaccccttctcttggctgaaaattgtaatggagacagaaataggtagaggcttaggtggtttgatcatagaactctacttgaagagctacatagctcaacagtctagatacataagaggataaaagagaatgagaaacaaaaagcaagtcaagattagttttctatgacctcaccatgcccacaagaataccaaactggcaacagaacccagagctttccctgttttaaagttaattttaactttcaagattaatgtaaatctaggtagccaagagtctccatcctatgtccagaggaaccaagaccagaaagctgtttcagagttgaatatctgatatttagtgatgaggttgtccttgcttgagtgctggaccttagttatccctaagtttcttgtgaggcgtgtgatgtattgacaagaacttaaagatttggtcatcagggtttctaggtctaaacatgagttctaccgtttactccctgggtgatcttgggcaaggtgctgaactactgtaagcctcaattctactttttaaatgacagtcagcattaccagataacgttggagcattaacaagaatatctgtgtcaaaaagtaaggaagtagtcaataaataagtaaataggtgaggataatagtatggcaaaggggcaccagaatttctcaacaaccaatgtttgaacaactagagcagcaaaataaataacacagttctagattataatctgaagtataaatatacatgaggccatactgatgtaaagaaatgacttcataaataaatacataaaataaaagtgtcaagtcatgcttacaaggaagattccaaacaacagcgtaggtagattctgtcccctccagtacccaggagatgcgatataattcctgtgttcctttcttaacattgactggggcatgcacttagtgactcgttgtcaaagaatatagtaagaaagggggagaaagggtatttttatcgtggagaaactaggtaaatactaccttaaccaaaccaataaggattaacatctccagcatgttatgtggatatcatgggctccttgtcattctgtgaacttcccctttgagatagtctcccataacctataattccagtctaatcataagaaaaacgacagacaaacataaattgacagtctacaaagtatctaaccagtattcctcaatctgtcaaggtcccgaaaccactgaaggccagccaagtctaagtaaacatgataagaaagtgccaggtggtatccaggatggagtcccaggatgggccaaggggtggggtggggagcattcatggaaaaattagtgaaatatgaggaacacctgaagtttaaagtaatgggtcagtgttggttcttagttttgataaatgtgtcatggtaatgtaaaatgttaacattaggaaaaatcagaaggtggtatactagaaatcactgtactatttttacatcttttctgtaaatctaaagtaatcatacaatttaaaagtttattagagaagaagaataagaattggacttgtaactaaggggtgtgttgcccagtaagtgacagaaaaaaaaatcaatttgtttattcttctttttcttacccatactgagaataagggctctcaggcactgaaggctgcacatcttatgattgcatctgcatgaaggtcaataataagcagagctaaagtgcagtgctggaagccaggagggcaggcacccttaaagggcatgacagtgacaggggtgggggcacgaggaggagaatgctaaggttatagacatgccctgtttcttgctctggattctggttacatagatgtggtcacctcgtcgaaattcatcttactggaaaattaatatttcttcacttttccatttttgtgttatacttaaatttacaaaaaaataaaaaagtttatattatggggctgggcatggttgctcacgcctgtaatcccagcactttgggaggccgaggagggtggatcacctgaggtcaggagtttgagaccagcctggtcaacatggtgaaaccccgtctctactagaaatacaaaaaatagccaggcatggtggtgcacacctacaatcccagctaatcgggaagctgggtcaagagaatcgcttgaacctgagaggcggaggttgcagtgagtcgagatcgtgccattgcactccagcctgggcaacaagagcgaaactccatctcaagagaaaaaaaattaaaaagtttatattaaagaataaatgtcagagataaatggagagtacagggttgcagttcatttgaggattgcattatctctccttcctaaagttcaatttgtgtctcaactgactgcatcaaaactaaccccaacgtcttttcaaggtcatctataacacacacaatgcatgctgctcttcaagtcctaagagaaaacagaattagtagggctgccttctcattcacaggatcataccttaactattcagaaattgacagttcattgtgatcaccaccaggtgtacagtatttagactaaacagacagtaaagatacaattccaaaagcttcatgataattccattttcatgaatccatgtatgttttctttcaagtttcaattgtgtttaaattttaggctgggaaaaaatagagaaaagacatttgcctttttctgagcaatttaattatggaaagggggtactcattttttagcacaatctggttttatctgaggttcgtctgtgatcagtggcaagcaactagtttttgtttttacacagggaaaaatatggaagcagtttttgactcaaaggccctactcactttgagttggatgtcccctgagaaatacctaagaagtagctttaaaataaattggaaagcgaagtaggaaaaaggtaggggaaggaagaggagtgaatgaagagtcagcaaatgagcaggtttccatttgaaatttaaattggcagctggcactatttgaatcattcttcatttaatataatttgaatggggtagatgataatcttgcattttgagaaggcaaagcaaaaccttgaatatgaggaatgtacaaacctctgttattttgcacagctcagtttaacacacttcccttcactatgcttagaagaaaatgaggtgtaggtactttagttgtttatttcttgtcagcacaatgcataaatgatgtaagcgcaagattcgaaccacatggtatgtggctatacacgattaaatggaattattgaaacaaggggcaaaaagaaaaccttgaacttgtgattgagtgaaagggaaacatccataatgttgaaattaaggtgggattaaaagatagtcattaataacaaagttatcatgctagtagaggttgatcagttaggaacgatatgaggaaaagaaaacttaattaactacagaaatatgtaaattactttttatacattccagataatgtgttttatttttctagaacactgattttgtatacttattttaatcagcattctgaatacaaacatctcaaaaatacaaacacttcacatacgaggaatgctaaaattagactagaaaacagccacagaacaaagagaatagcacaaaagagtcttacaaggaagacattctgacagacccatgaaaatagacacagtgtcctagactggatgtattatatcatctcacatattagagaaggggactgattgttattgttcttctagagagaatgtgcattttgccagcctgatcagattttatcctcatgatgtttagaggtacatattgcttctccggttttatacatgaaataattgaagcttgaaaaagtaactttaggctcaggtagttatagaaaccatcagaatttgaacccaggtcttatgtgatcctgaagctactgcccttggttaacattttgcagacatctccattttcctcagtgacaaccaaggaaatcatatgtattagaaaaatctcagggaaattttagatatatttagaagcatgaggaaaaaaatgggaattaaaaaaaaaaaaatcacatctttacgaaaggtacagaagaatgggccgggcacggtggctcacgcctgtaatcccagcactttgggaggccgaggagggcagatcacgaggtcaggagatcgagaccatcctgactaacacggtaaaaccccgtctctactaaaaatacaaaaaattagccgggtgtggtggagggcgcctgtagtcccagctactcgggaggctgaggcaggagaatggcgtgaacccaggaggcagagattgcggtgagccgagattgtgccactgcactccagcctgggtgacagaacgagactctgtatcaaaaaaaaaaaaaaaaagaaaaaaagaaagaaagaaaggtacagaagatagaagaaaataaaacaaatgatgaatgattctaggaggtgtaactgattctaaaggagttggaaactacaggcagtgacatccggaccccaactccccttcaagagcacctctggggtgtaaaggggaaaacagacttgggaattaacctacttggggtttggagtctggctctataaaactatttgtgtgactgcctgcaacctctttgtgtttctgtttgttaatttatgaagtaggaaggataacgtctgcatcattgaagtttattgtgaatattaagttagatgatacaaataaagaactgaatatacctagaatccattaagctctcggatgttagttccttcctcatttcataatatttctcttcagtagaatacagaaaagggcccacaagggatggatgttatttgctctgcctatgataagaaagaattttagagtcttgccaattattcggcctcatgtggatcaagcacatagatattaggtctattcttttccttttttttctgtccagatgcttggattcatgtacatgaaactgcttgttgcataaggaccaaagactgaaatattaataatggaattgcattttcatgtggactcaacttatcagttcccaaatttctaccttgctgtgcgaacagagaacatgtggaaacgtctctaggtgtctgcagttcactcagtttctctaattctaattattaatatggcattagacatagaagagttaagaagctcaagaatcagtctaggattacttgcttgtcatttaatgtgtcagcctggtaaagacaaatattttatgtaaattcaacaagaagtaaaagaatataaattatctagtggccaatagcttaaatacataacctgggaatataatcagccatgagattcaggaagggtgtttcacagttgtgcataatttataatgagagggcaggtataaatataggtaataagggatgaaggtatttatacttttaaaatatttaaatgtagtttgattacatccccaaataactttttctgccctgtcatctggtgtaactaaatatagcctggcattctggtagatcggagatgtatcttctctgtggataattagcctcttgtattaaaaataaaacctataaatatcacttcattagtaggattctatcctcttccctgctctctttatgatctggaataacccacagacatttagaagtctaatggccagaacgaaataaccgaggttggttttcggggctgttgagtgttgtgggtcaataatgaaaacggactgctcctaggttttagatcaacgagctctcaagggaaataaatgaaatgaagagaccatgggagtcaggaatttgctagttgcctcatttccactttttgtatattcttcttagttttccttgtacattaaatcattatgctctcaccaaggagagaatgataagtacctgattcataagatcttcttttctaagtaagttcctaattttttcaagggtaaataataataattcaattcttcagttcttctaagcatcatctatcatgagttcaaatatggtcacattaacataaatgttcaaactatgatagctcttaaccattgaggaacttaacttttcccctggatttttttcaggagtcactgaatgaaatgagatggctgtgtccccacccaaatctcaacttgaattttatctcccagaattcctacgtgttgtacgagggactcacggggaggtacttgaatcatggtggccggtctttcccatgctattctcatgatagtgaataagtctcagagatccgatggatttatcaggggtttccacctttgcttcttccttattttctcttgtcaccaccatgtaagaagtgcctttcacctaccaccatgattctgagacctccccagccatgtggaattgtaagttcagttaaagttagtcctctatttcttccccatcttgggtatgtctttatcagcagcatgaatacagactaatacagtaaactggtaacagtagagtggggcattgcttaaaagatacccaaaaatgtggaagcaactttggaacttgggtaagaggtagaggttggaccagattggagagctcagaagaagagagaaaaatgtgggaaattttggaacttcctagagacttgttgaatggctttgcccaaaatgctgatagtgatatggacaataaggtccaggctaaggtggtctcagatggagatgaggaatttgctgggaactggagcaaaagtgactcttgttatgttttagcaaagagactggtggtattttgcccctgccctagagatccatggaattttgaacttgagaaagatgatttagggcatctggctgaagaaatttctaagcagcaaaccattcaagaggtgacttgggtactgttaaaggcattcagtttataagggaagcacagcataaaagtttggaaattttgcagcctgattatgtggatagaaaagaaaaactcattttctggggagaaattcaagctggttgcagtaatttgcataagtagcaaggagcctaatgttaatccccaagaccatggggaaaatgtctccaggccatgtcagagatcttcacagcagcccttcccatcacaggcccggaggccctggaggaaaaagtggtcttatgggccgggtccagggtccccgcgctctgtgcagcctagggacttgttgctctgtgtcccacctgctccagccattgctgaaaggggccaatgtacagcttgggctgtaggggctgtggcttcagagggtggaagccccaagccttggcagcttccatgtggtgttgaggctgtgggggcacagaagtcaagaattgaggtttgggaacctctgcttagatttcagaagatgtatggaaatgcctggatgcccagataaaagtttattggaggggtagggcccttaaggagaacctctgctagggcagtgcagaagggaaatgtggggttggagaccccacacagagtccctactgggtcactgcctggtggagctgtgagaagaaagagggccaccatcctcccagaatggtagatccaccaacagcttgcactgtgcacctgaaaagccacagacactcaatgccagcctgggaaagcagccaggaggcaggcaaagccacaggggtggagctttccaagaccatgggaacccacctcttgcatcagcgtgacctggatgtgagacctggagtcaaatgagatcattttggagctttaaaatttgactgccctgctggatttcagacttgcacgggccctgtaacccctttattttggagaatttctcccatggaaacagctacatttacccaatacacataccccatcgtaactaggaattaacaagcttgcttttgattttataggctcataggcagaagggacttgccttgtctcagatgaaactttgcactctggacttttgggttaatgctgaaatgagttaagactttgcaggactgttgggaaggcatgattggttttgaaatgtggggacatgagatttggaggggccagggcggaatgatatagtttggctgcgtccccacccaaatctcaatttgaattgtatctcccagaattcccacatgttgtgggagggacccaggggcaggtaattgaatcatgggggctgatctttcccgtgctattctcataatagtgaataagtctcacgagatctgatgggtttatcaggggtttccactttggcttcttcattattttctcttgccgccatgaagtaagaagtgcctttcacctcctgccatgattctgaggcctctgcagccatgtggacctgtaagtccaattaaacctcattttcttcccagtctcagatatgtctttattggcagcattaaaacagactgatacacaaagaatgtacatttagtagttgcccttcatgaaaactcaagagcattgcttctcaagtgctaggcattctactaccttctcctttggacacacgagtgctcttcaggaagccgctcttgtgctgaaaggtcccagagcagtactgtgaactttggggcaatggaggaggtttgggcaacttctcctcttaactaagttgttcttggttacctgtcccctgcagcagatgcttggcccagacacatagaaaacctaatataaacaaacactttcagtacttaacgctagcccttctctcatatatcaactaggtctggctaagttatgctacccacaaatctcagtggcttaaaaccaaaaaaactttgttttgttttgttttgttttttctcccacaaagtgcctctcagggcttaacaaaggagctctgcttgtgggagacactcagagaccaaagtgagtggattagctctcacctcaaattctgctgcttcctatgccagagagaaaggaaactatttcaaggacaattaaatgcttgacctgaaagtgacacattgcactttcacttacaacttattggccataattatcatatgaccccacttaggggcagggaaggtccaggaagtacaattctatcatgtaccctcatggaggggaaactggagacttttggtggacacaacaatctctttgtgaaagggctcaaaacctggctgagtgagaaccattaaaagcctatcttttttattctccatgatttccaatcccctcccacctatgcccaggcacttctatgcagaccattcctcaggaaataaacaaaattatccatctcagggaattaattgatgcaaacagataccttcagagtttctttacttttcaaattcactagcaatctaatttggactcagctaagataccttacaataacatatttttatttttgaatgatgtcgacattacaagctattttacaggctgatttgattctcatgaaaatgtttgcaactgaagctagccatgtattattttccccatttgatattataaagctacatctcagaaagtttgaatggcttgcttaacactaccaagctagttaatggtaaaatttggtttacaattttagaatccaagcctaactattcttttcttactaaaccattttgatttattctcagaaaaaggaataaattgaactatacctcagaagatacagggaagtttgcttatttcttttcattatattgcttttttgtcgtaatacctgggaatgatatgtgtcaatgtgagtcaaagaacttgttcttagatcgttatgagttatcaggaaaatattaacttgtcttaataatctgagcaagttatcaccagacttttaattttacctatttcctaaccccaaaagcacatatcagaaaaatttggcatattacaataaaaccatatgctagttggtaatattgaaatgaataataatgtcagacaatagtgtcacaatccaaccatttgcttgagtcaaaaacttataatcttccttgattctccattttttttgttgtttattgaactctccagccctatctaacccaacaggaaatcccattctctcttcttccaaaatattttaaaaccaatctcctctcaccgtctgcacagctagtacaagccgacagcatccttcccattgagtacagaatcagtcgtgaaactaatttccctacttcctcagattcttgttggagtcattttttacccagcagacagaatgatcttttcttaaacattttttaagttacgtaacataatgcacatatgagaaagtgcataaaacataaatacactgcttaactaattgttgtaaggtgaacactctagtagctattatcaatgggctcaataaatagaacattatctttacctagaagcaggagggacaggtatttctgatcaaaatcattttttcttttgtacatgtaactgtgttgatattttattgatacataatagttgtatgtatttggggggtacgtcttacattttcataacagtatgcaatgtgtaatgatcaagtcagggtaattgggatatccatcacctcaaacatttattttgtccttttgttgggaacattacaattcttctcttccagctattttgaaatatacaataaatattttttaactataatttccctgctgtgctattgaatactagaacttacttctatgtaactgtatttttgttatggtaataacttccttatttggtttatatgtactcacaaataatataaattttctaacttcttttagaattttctattaaaaaattatatcattgtttattatttttgtatctaacttattttatgatatacgtatctatgttgctgtgtgtttctgcacatagttttgttgatatagttgttccagttctctgttgctatgtaacaaaccactcctaactggcacagaaagaactgttttattatgttcatagattctgtgggttgggaattcaaacaaagtatagcttggagatttgtctctgcttcataaagcctggggtatcacctgaagaggctcagatgtctggggactagaattacctggagtcttcctcatttacatgtccagcagctgggctaaggtgacgaagcaaacactacaaatcagtgtgcctgcaagtgtctattaacataacctgggcttccttaaagcgtggtggtgtcagaggagtcaaatttcttacaagtggctcaatactccaagagaaaacgtttcagcagcgctggacagaaacacatacccttttatgaacacacgtccttttatgaatgaggacacatgacatcattttcaccaaattttgatgattagacctgccacaatcccaaatgtattcaaatggtggatccatggatccagcatattttaaacaacaaaatagtattccactgtgttaatatactataatttaattattcattctgttcttaatagatatttgagttgcttccattttgaactattatgaacaatacttctgtaaacattctttggtgtgtattctggtataggtcagcatgcatttctgaaagaaatatacataggaatataattgctaagttttagagtatgcaatattcagctttatgagataccatcaaaaggtttatcaaagtgattataccaatttacactgcccccaaacataaaagtgggaacactcttgccaacacaaactgagattttcggaatctaactttttttttttttttttgcttaatgtcccttggaaattccaatagcacttgacataaaaatgaaaccgtttaccgtggcctacagggcttagatgacctggtctctgcacttctctgtggacttatcttcaccttgccataaggctgcagcctcatgagcctcctttctagccctaaaacaagacaaactcattccccacctgggacccttgtacctgctctttcctctcctggaaagcacacatcccccaagtccaatatctgttcctcaaggaggacttgtgtgaccaccaatataaaatgcattccactccccacccctagtttctccctttaatgctattctgttttcatcagatcacataagcaccacataaaattatcttttttatatgcttgtttatttatattgtgtctattacccctagaatttatagtgtcttgaaatgtgtaaaagactgctttttgaattaatgcatttttataattaattaagtaattgagtaaacttacctagctgtgtgataataggtgttatgttttttattcttcttatgcatttatttatgtcaagcacagtgcttgggactagtggatgttcagtaatattaataattgaaataatttggctcacattaatgttgaagtggaaagaaattttgtgtcctagattggccaagttttaagatgggttgatcactctgggctctgagagattagaaagaactatgtttactcctctgtaagaaggccatttagataacccacctgactgtcctcattatcaattttctcctttttatttatttggtttctttctattgtctgttcactcaccctttgatggataatgctcaggcatcttctgcaggttagcctgacactaaaatttaactctcatatttttgaagcttcgataaaagtagtcgatgctggaaaactgtctctgacacagtgagcagctctttgttttgcagtaagtggagtctttaaaaagattgtgatttttattgtccctttctttgtgacaatcgtgtgaaagggtcagttaattatgcaaatttggaacttctgagaggaagccaattgagaagcagtgaatgaagcaacccaatcaccctggaggcagagataccccgtcctcttacttggaggctgtctcagctcaactgagtgcagtgactctttacctgcatacggcttgcgaaacccactcagagtctattcaatggatctgcagcagggtctgagaatctgcatttctaacaaatccccaggtgatgcagatgctggtggtctgagtgccacactcagagaaacactgctataagacgagctgttcttttccccctgaatatctgaatttgtcctttttgaacttccccttagaccccaaaggcctatactcaaaactccaattgtatatccagccccatcttctttttggagtgggactcccatgtctttcaatgatcactagacatttccaactaaatgagattttgacggttcatactcaatgaccttgggaaagtgccctaaaatccagcaccatttcctcttccatattttgagaaatagtgtgcctttgtttctcaagttaccaagacttaaatatttttccaccgttttacttctcgatctgaactcttggtttactttattatcataaatatgaagagtgatttctagctagagtaatagctactgatgacagatacatttatcactgtggaaaaaacacctacgtcagctctttctgaattctgacgcacagatcaaagcttggtaagtcttggtagtctgaacaagcgccttctggagaagtttaaatgtaaaacaaagatttccaagtgccatcatgggttaataattttgaatcagaaattgtgagaatgatgcccaagaatcagcatttttaataaataagccttgggccaaatttgcaagccactgacttagatcatcatacaataagatattttaatgccacttggttaagtctggaataatttaatccttcttttatacttaagggactaaatcaaaaggcacattttccagcaatattagtacttccaactcttctttttccaacagtgacttgatgtgtgtgcagatcaatgttagttttatgttactatattggtgttattttctttattccttgctgatacccactttgggactctgcatgcaaagtgcctggataatgatgtaacacagagaagggtcctcaccttgggttttcctctaagactcctctgctagcattcctcaagcttgccagagcagtttatgcacataattgatctaatctttatttatcaatgaaactagccctgcggtttttcccagaagactctttggataacacagaggcacaacagaaagggcaccatgttaaaaatagaataaataatattttacagccaaaatgattgtcaccacctgttatatctttctcatctctgggtctctcctttagatgcattttttcccagagatttcttctaaggcagaaccagcagggaagaaaacaatcaaatgctttgcagcctggagtaaactttcacaggacaggagaagatgtgagattctcagcttctcctcccaataaaaacagcagcaatggaacagcatctcatatttagatttcaacagactggagtagggacaggggacagaaattttgcaaatgatgcagcttagtcaatgaatggcaacatttcagaaagcttaaattcatatgatgagggaggagatatgtctgggaacgaaagactagggaagagtctaggtgtttattcagcatcttcactgccccatctctgcacacagtttttgctccataccttctttgccaccaacactactgcccaagtagttgcttctaccacatttaccaccaccatcacctccaccatctccactgccacaaccccaccatcagcatcaccctctccaccaccatccgttccaccatgacaataacttccaattccaactccactctcatctggactttcaaacctgccacttccatcaccatcacctcaccattatcaccactcatcccaccaccctcacccctcatgtcaccattatcacccctcaccccaccaccatcaccccttactccaccaccactacccaccaaccccagctttccagcttcctcctgctcaccttcacgttctctctgctgagcagaggagcttcttaacactggagtttaaacaattgatgaaacatcatccgtgtgttctctctacaatagagcagaaaagatacaatttcttttttggactcacatgagtaattcatatttcccatttgcctagggccaggttttcaagaacaaaagctctcaataggagaggctgtccggagaccttgtatctctgctctgtatttccatccccagcaggaatggttcggggcactgcttggctttgccctgggttacattttcctctatgcgagtttccaacctgaagtcagatctgtttaaaataaaatgaaagcctctgtcagggagaaatatcaaaggatgactcttgcctagaggtagcacctacttttaatttttaagtattttatagagaaacatgtaaatttacacaatctgcagaattgttatttgcaggaacctatggtctcttcagagggaaattagaagttagaaagtcttaagaccttggtttgctgtattttaaaaggttcagtttttcttaaaatgacggtgtgaatcttttactcaagaattgtaactaggctggtcacggtgactcatgcctgtaagcccagcgctttgggaggccaaagtggaaggactgcttgagcccaggagttcacatggcaagacctcatctctacaaaaaatttttaaaaactagctgggcatggtggaatgtgcctgtcgttccagctactcaggatgctaaggtgggaggatcacttgagcctaggagtttgagactgcagtgagctgtgattgcatcactgcactccagcctgggcaacagggtgagacattgacacacacacacacacacacacacacacacacacaattataattaaaaaaaaacgagcagtatcaatgtctttgttctcacctctgtatctctacagcttcctcctactccgactttcacctccacagtcttttgtttgtttgtttgtttgtctgtctttgtttgcttgtttgtttttgtctgtcataagcattccaagatgaaaaactgagtgcctgtcacaaaactgaaaaagttcacagctctgagctcacaaatacatggttttggggttacataggccagatatccagtttataaaacaaagaaatataggcttggctaatgcccaaggatagaacaccacccatgattccgtattttttaagatgcgatggtttccctgggcaacagtgttgaattacgtacatgcatcacgtacagctgtatacagcgtgtggtccatataaaattaagcccacgaggactgattccatacaggaagctcctcatcttcgtttccctactacatttatcataataacaattcaaatggtctggatactaaacataacaattcctgaaaggatctttcattttagactgcttgaaacaatgattttttgataatgagtgagcactctgaattgaaaatgatatacaatttactgcaaataatcatacactaaaaacatatataggaaggaaggaattaacaaactggctataaacatatttgattctcaatcctaagaggaccacaaattatatatatgaactttgatgagttgggttatctgagttttattttcttgatttgtaaacaggaataaaataccaaaattatagacaatatttgcaaagtgcttggctcctgcacgcagtaaatagtgtctctacatactttggcttgtgctcttagtctttagttccttctcaacaatcctgtgcctaagaaataggtattgctggttggtatctgctgtactgtatgatctatgttctttgctctttgtttcaaaatcttactaccttattctagtttggagtctttgtgagaggcacaggtacatggtctgataacattttgagtctttaatccaagtgcttgtcaccattgtctttggcagaagcattatgtctatggaattaaattttttttttttttcactgtacagttttagtgtaggaagggagaggaaaccactttcagtgggatcaggtttacttggcttggagaagaaactgaatgtggattcctcatcaagaatatgcttgtaacactagtaaatatttccctagtaacaatagctgggaggaggaaatcatgtttaataacttaatgccaaatagcctgtggcttacagtggcacgcatgaacacacacacacacacacacacacacacacacacacacacacacaccacgagctggccattagctcaataactgttttaaaactctattatttatctcattttagtaaatcagataatcaatatttatcgattatgttcatcaccattttggtagacactatgacggataacaaaaggtaataggcatagtctccacttggaaagccattacagtatttaacaaagcaatacaaccatttgataccaattaaaagtaagttttggtttggaatggtagtaacttccagtgacgtgagctttcagaggatggcagctagttaatatagtattctctttgaaaaagacaactgttgatgtgtggagtgttagctatgttcaaattgagaacgtgagtgaagacttattattccccttctgttaacatctcatctcttcatctttctggatcttaggcttttttttttcctcgacattagtactgtacaattgtaatatgtaatttaagatattctaatagcctcattttttaaaaagtaacaataagtatctggaattaactataatgatatattttgtttaatttgatatatcccaaatattaccatgtcagcatattgcactggcacgtttgaggcacccgatagctgcatgtggttagtggctaccgtagtagatatggtggctctcgagggtcctcatgcagtggctgcaggacctgacctgagcttcatcacatctcttattttagaaaaaaaaagctgactccattgatggacgttcagcattgtgtcaagaacagggaatttctcctgtcaaagccttctttattgtttcttcttcaatttacccacagcggtcctggctaggatcctgtcatggttctcagtccttccctctttccttcagttgctgctgttgctgtccagctgaagattaaggtagaaccaaccgtggaggagctgccatgggcttttgttgtctacgggtttggggatgggacatccagaggggcctggcaggagtttaattaggattacagatgagggagacagaggaaagcaatggcaagagaagggggcaaacctgaacagaaggttccctccacccttctgctccctctcacttcaatgctggagtaataggatctgccaaatctcactttccccacctgggatggtgttggcaggtggtagggtcaaagagtaaagagaagcgagtctcatgtgggcattttcaattccatcacatacttttacttacatttgcatacaggtcagagtcaaaaatattctattttggtacctgatctgaaattatttgtaaataagacaattaaattcatttactccaaaaccatcacctcaacatctgaagaatgcccagcattgagccaagcactcatgtactaggaaaggtaggaagtggcccccgttctcaagggtccctgtcacacattagctaggaagtttggaggggtcatcaaactgaaactttccagaaacatctgtctgcattgagggtatattcaggacagaagggttacaatcatgtctgcttcatttttacttgtatgtagtatactttttaagttgtttttcaaaaaagttagtatctaagtggacaaaattaataggagcaattataggagcataacctaggtagagctgcctaatggttgaccttctaacagtggaatttcagtcatcactaaatacgtagaagacgcattcagggaatacactgtctttctactccctcaattatgtcactgctttatctgagagcaatggagttgtgtaggctggtgcactgaaaactgtcaattgggagtcaaatatctctcatttttcaagtagtagccagcctctggggtttgagcaggtcccagttcagccacctgttttttgtttatctttggccaatcacttaaattttcttagtttttttttttttttccacttctaaaatgagactaataacttcatctagttacctatcagttgcaaagaaatgagataaaaaagctatctatgaagacacatctcctcaaatgtgtttggcatcccaacagtaaatatagatcatgttactcttgaaataaaggccaaaaaatgtcttcactccccgtgtagaataaaatgcagtctgcttattacagtcttgaccatgcacaccaagggcactgtctccagctgacactgtgcgccagtcacgttggcctctaaacatgttcctccctttgttagcccttttttgtctttggaatgttcctccccaagggcaaaggtcaacaaactttcactctaaaaggccagatagtaaatagtttcatcttgggggccatgaggtttctgtcacaactactcaactctgccatcagagaagaaaagcagccataggcaatacataaacaaatgagcaggcctctgtttctctgttccaacaaaactttatttacacaaataggtgatgggctagacttggtccatgggccaccatcgtttgctgacccctccctagaccttttcataatggcttttctgatcattttaatctcagatcaattaggatctaaggccttccttgaccactcttttgaacatctccccaccccatctcttgattgtgttgctccgttttattgttttcttattatttataacctcaattatctaatgtattcattcgcttattgatttattgtacacatccattttctgtaccaccataattctagttcgaagggcaaggtctggaagaaagtagatggtaggtgctcaataaatgatttgtttcatgtgtgaataaataattacccaaagaataaaattccagaaggaaaattctgaattttagtgataggaaggcaagaacgcttgggggtagtcagaggcacaggaagatcagaaactcctgcaaactatgagccttccatataatctttcacaaatgaagcttctaaaaagctgacctgtatgaaacaaggtagttttttattgttgttgtctgcgcatgatatagactgttaatatctcactattttctggctataaaacaagcatactgataacagtaaaaatcaaaggtataaataaccggcccattagcaggctgtatgcttggaaatggttttgagggagacttttaaaggcagcttttaataagaccagccattcattccccatgcaatcaatcagcattctcaatcaaatgccaatggcatgcctttgtggttgctactgaggatactggcaaaatgaggcagcctctgccttctcagccatcaagagtaattatgtaatgccatatagacaaagattagacctatagtgatagggggatatcagccagtgtcctggccaaaaaaaaaaaaaggctcacatgaaaggatttaaccaaagagatgttaatgaagctatgccactcttatgtacagaggtgaggatgaggctaaagaaaccattcaggagatgtgagggaccctgggtccagcaacagttggaaaccactctaacctgtaggctagaagtcttagggagaaaatgatattaccagagtccagtgagaactgatgcctgaaggaggggccagccaataggagttctggccgtagagaaatgtggctcttactagaatctcatcaagacaagctttctatacttccaccctgcctgacataacaggaagtcagagggtaagagagctggtgtatgcaattcatgggagtcgggctttcagagcaccaagtaaggtggagaaatgcatgtgacattaagaactgagaacaaaagaaacataacaggcacagtagtaagagtaggtaagccaggtgataagagagattgcattttggaagtctgtatttactccattgattttatttactttgcaatatgtgaatgcagcagaaaataagggattaaaaaagcttttagaaatgtgtattttttaatacttaaggatgtaggctagaagagttctaggattattggcagagtttatctaactcaagccaattcatgtgaagtcaaccagagtcttgaaggattagaaaatacctttctagcctgttgcctggggaagaaacattccgaactaaggataatcttttgcctgggaagaagaaaccatagagtaaaattcatcaccaagataacattgaatcttcattactgcccaaaaagagagagagagagagaaatttaacatattcctggtaatgaaggtcagtcacttataagcaataatttccttttttttgaccattatcaataaaaatgaaatctctctttagcctgccaaaagaaaaaattataaaaacaggacctgttacaggctctattacagaactttgaaactggtatcttaggactatgctctctaacagagggtcatttcttcaagtaactatatgttgaactcttattatcaaatgatgaattccagtctcccaaattactacttgcttttattaattgagttagtgatgcattacctcactttgttgcatagtttttggtccaccaagtggctgcacgaaagaaggaaatgaagtgctggggatttccttaggcgattacaagaagacaacttttaataccaaagtatttatcatttatgattttcctagttgtcttgcagtgatctaagcaacttgttttgtgatttattatagatcttatttaggtctgtttttttaaagagaagtttcaaggaaaaaggaacctctataaaataatttcagtcggtgtcgctgttcagtagatgacatctgctggaatgaatatggtctagatgctgctccatctcctttacagattgtatgcttgtctagaggatgtatgccacattttatccatgaaccttttctaccacacgcaccattctttatccccatgccccatcattacgccaatgccattccctaataaatgaatgtgaggggttttaattattttgtgccaaatttcttcaagcaactatatgttgaactcttattatcaaatgatgagtttgagtctccaaaattactacttgttttcattaattgacttagtgatacgttacctaactctgttgcatagttttggtccactaagtggctgcaggaaggaaggaaatgaagtgctgggcatttcgttaggcgattacaagaacacaacttttaataccaaagtatttatcatttatgattttcctagttctcttgcagtgagctaagcaacttgttttgtgatttatttattggaacttactaagcttttttttttttttagatagacgtttcaaggaaaaaggaagtttcataaaataatttcaatagatgtctcgttaaaattcaagttgatttcagtgctattctgacctagctaccaactagctttgagaccccaaacaagccacttaccctctgtgatcctcagttttctcatctctaaaatgagggggatgggctaagttgtccctaaagccctctaaagtgctacatgctgtaattatgagtctatgttatccccggaaatatcatgaaaaataaaaataaaattgattgagttgaaaatggtccaacagttacaaagaaatatttgacattgtaatcatgcatcagttagtttttggctctttaattttgaaagcagatgtttgattgcttgtttaaagcctgcgtaaaaaaccccaggcaaaccttgcaaaagctcaaaatattcttaagcagggatatcaattgcataatttcctagaccttgcagattggttcaaattaacccacagcatatttgaaagcctttttcttttgtgagcatctaaccaattccccattgctctcctcctgggtatctattcgttatcaaaaccggaagcacagtgtggcatccaaattggagttcagtgtcagcagaggttacatttgtacatttcccagaaaaggaacaattattgtcataggagaggattaatgtacggccattttgggtctttattataatcttttctttaagaatgaggaattggaatgttaatgtattcaataatctatgaattatacaggtatgctatagtgctttgaccttttcaacatttggtaattttgattgagtggctgttctgagcctgttctttttaacagctctattatcctgtggaaaagaggaaggctagccaaatttcaaaaacacatttatcccgaagcaagaatagagggaattagttacaatgtgccagagagagtgcaagatgacttacagaccttctctgatgtaacctcaacaacatctcatgagataatattattatcaccattttacagatgaagaaattgggacccaatgcatgcctcatgggtaagaggcagaggcaataataatcccagtactatatgatatcaacatctatacacttgcacaaaggtaagagggagaggcaattattacccctgtactatgtgataccaaattctatacacttcctactcaacaggtctttgatttttgaaagtagtaagtgtatctattaagcagtaaatacctgtaaacatcctgcattagactgttctcacactgctaatgaagacatacctgagacagggtaatttataaaggaaagaagtttaattgactcacagtgcagcatggctggggaggcctcaggaaattaaaaatcctgttggaaggcaccacttcacagggcatcaggagatggaacgagtgctgaggggaaggggaagccctctatataaaaccatcagaccttgtgagaactcactcactatcacaagaacagcatgggggaactgcccccgtaatctaatcacctcccatgagttcccttcgacaaaacatggggattatgggaactacaactggcgatgagatttgggtgggtgcacagccaaaccatatcattcttcccctggaccctcccaaatctcatgtcctcacatttcaaaatgatatgtctccgatgagtggaggaacacccggttcttcatcttcagtcaaattagataaaacaacatggatacacatggaatggttttgagaagtggagagtttaatatgcaagaaggaagtggggagaaagaaagaagcagatccctggtacacagacagagggagggggcctccaaagccaaaagagggaacttcaagtgccaaggataccagccagttttatgagtaggctggaggaggtggtgtctgatttgcatagggctcacgggattggtttcaccaggtatgtcgttcacatagcccgtgaaaaagctggccctcccaccctagcctgttgatatgcaaatgcagggcaccatgatgttctacacactggggatatgtgggggtggctatgctgctaggcatatgtgagggcaaggataagaggacaatggtggtgagaattgccatgtttgatggactcagtttctaatggctggcatttgcacatcaaagattgcctgccaggctctaaaagtgggggttttccttctagacaagaagcatttttgcagctgctttaaaagaaacgaaaactttttctatctgcctaaaataatttcttaataactcctaccacaaaaacacaaccccactttcccaacagtcccacaaagtcttaagtcattccagcattaactcaaaagttcgagtccaaagtctcatctgaggcaaagcaagtcccttccacctatgagtctaaaacaaaaaggaagttagttacttcctagatacaatggggtacaggcattggttaaatacatcctttccaaatgggagaaattggccaaaacaaaggggctacaagctccatgcaagtccaaaatccaatagggtagtaattaaatcttaaagttccaaagatgatgtcttttgactccatgtctcacttcttctgagtcatgctggtgtaagaagttggctcccacagccttaggcagctccacccctgtggttttgcagagtacagctcccctcttggctgctttcatgggctggagttgagtgtctgtgaattttccaggtacatggtgcaagctgttagtgaatctacaattctggggtcaggaggatggtggccctcttctcacagctctactaggtccaccaggcagtgcccagtggggactctgtgtgagggctcccaccacccattttccttccacactgccctagcagaggttctccatgacggctttgcccctgcagcagactttgcccctgaacatccagatgtttttttacatcctctgaaatctaggcggaggttcccaaacctcagttcatgactttggtgcacccacaggctcaacagcacttggaaggtgccaaaccttgaggcttgcactctgaagccatgacccaatctgtaccttggccccttttagccacaaatggagcgaccgagacacaggacaccaagtccctaggctgcacacagcagggggcccagggcctggcccatgagaccattttttcctcttagcctctcagcctgtaatgggaggggctgccacaaaggtctctgacatgccctgaagacattttccccgttgtcttggtgattagcatgtggctccttgtttcttatgcaaattactgtagcagggttgaatttctccccagaaaattggttttgcttttgtattgcattgccaggctgcaaattttccaaacttttttttttttaatgctttaagttctagggtacatttgcacaatgtgcaagttcgttacatatgtatacatgcgccatgttatgctctgcttcctcttgaatactttgctgcttagaaatttcttctgccagatactctaaatcatctctctcaagttcaaacttccacaaatctctaggacacgggcaaaatgccaccagtctctttgcagagcaagaatgacatttactctagttctcaacaagttcctcatctccatctgagaccacctcagcctggactttactgttcatatctctgtcagcattttggccaaagccactcaacaagactctaggaagtttcaaattttctcacattttcctatcttcttctgagtcctccaaactgttccaccctctgcctgttatccagttccaaagctgtttccatgttttcaggtatctttacagcagcaccctactctaccggtaccaatttactgtattacttctcacattgctaataaagacatacccaagactgggtaatttataaaggaaagatgtttaactgactcacagttcagcatggctggggaggcctcaggaaagttacaatcctgggggaagggaactctttgcagggaggcagaaaagagaatgagtgccaaacaaaacgggaagccctttgtaaaaccatcagatctcatgaaaactctgtcatgagaacagcatgggagaaccacccccataatctaatcaccccccacgaagtccctcaagcaaaacatgggaattatgggaaatgtaattcaagatgagatctgggtggaggcacagccaaaacatatcccatcttaaaattttatcttattccacattgagctttcaagcatttattagtacttatgatgccctgtaaccttctgtagctggtagaatgatgaaaaagaccaaaattccccaccccaaaggagattagagctgcggagtatattgactcagggttatgggaacacaaaagagatggtgaagcacccagagatgagtgattctggtgaactggtatgtaacacttctgctcagagcataaggaacagtggaaggaaacagtgttaccagggccatatggaaatttgaacagtggatgtaggactacccagtaggagctacttccaaaaatggtatgctatggctagaaaggagggaaataaaataacccattctctctgttgttctctgttctcttaccagtgtcccccattagctgaatccagccagatgtcagccatcacaaaaactcagtctctaagggtttcactcagagcagggcaaggatggatggaaagggactgggaggaaggcatgtagaatcatcaacagaagggctttccaaaactaaagaataatgtggcttgaagataaagtcacatctccatttctttcaaaacagagtaccagcaatttttaattgattttttcctcagcttctacttaccaaaattctctggagttttaaccagagtagtcttatgtgtggaatgaagaggggaataaatggtaccaaggataataggatgagctcaaatcagtctgtgcttatgaccttagtgttaatactgtgaaatgaaagaaatatcgtcatttctcattttggtgtagagatgctaattctacactcctcttcaaattactgagataatagtatgtgactgatgatgaattcctagataacactgggctgtgtgcctttgaaatattgagagaaaaactcatgatattgatagtccattagactagaagatgagatttcaaaatgacaatggtaatgagggttcgtttttggcaaccaccttgattcagttctataaaaggcaaagaaataaatacatgactcccctgagtgacatttagacaaaaggtggttctgtgccattgtcggatagctttcaaaatcaatggattcagcaagttttgttcatttcagatatttggtacatcagagttccatgttagtttttttttttattttaagatttaattattagaaataaatgtacttagaatattggagacaggaaagaatattaggaaattttgttattgctaggaagaatctaaaaatagcgttaattgattaaaaagtgaattattgtgttagaaactttgtcttttaacaattacaaaccaaaattctaaaggaatatctaaaaagcttatgtaataaagtttcagaagactaggaaaaatagccttataagctctagatcctctctaacagagatactgttgtaggtaaaggagacacatgctccaataataagatgaaaccctggtaaccctggagtggcatcctctagcaaacaggagagtaggctttggtttgattcactcaacaagtgctcattgagaatcttctccgtgcagttaactcaatgctgtggaaggtataaagctatcataatatcagctgtagacaaatgaaaaggaatgcagttatcaagaacttcagagaagtgcactttttgctgagagctttggtaacctcatctgtcagtgtaaaatcaatcagggatcttccctgtaggctccgagagtgactatatatttctcccttcaaaatgttttatccaagataattagtttaacatttaatatctgggacttcctcacaggaggaaaatgtcatgaaagaggaaagcattggaatctagaaagtgataatataaaagttgaaagaggcatatttagtctgctttgcctttgagaggaattgtatgcctgttgagttctatttcttttaccttcatgtgctggctggctgagtcactgggcaactgggacccagggtgtccacctgaccaggtataatttcaatcatgcatacagttgtcccaggattttcttgggttatagaatattttctaaacataaagaagctatctctcttgcttctctcccgaagaattactttcttatcagcttaggcataaaccgaaaggatgctcaattatatgtgcataaaataatgattcattgaagcattctatgaattttatgttcccccccaactccaaacacagacccagaatttgagataaagagacatatgcaatttaatattatttaatgcgtgacgagtctgatggaatagatattcaactcagtgaccttgaagtatagagtggctagtatgaacagtttgcatgctacactgtatagcctaaataacagagggcataataaagtaaaaactgtaaggttgtgatcagcttctactggtgagggagagagatgattaatggtgtaacgaagaaattatcatggtgtttctattttctacaaagctgttttcagcttcaaattagaagttactctttttgccaaaaagagtggggtataaaccacattccaattgctgcaataattctgacaaactcaaaggcagatagcaaagcatctggaaatgggcagatcaaaatgttgtcttgaaaaatagaaaaacaacctttccaatggaaaaatacctggtttgtagcattttgcagcatatgtaatgtatagagtaaaatgtatgccctgggtagctaagaagagaataaaaatgaattaggagaacctaaataataaaataatgttgttttcataattatatataatgggaacaatttatttactgacttcactgaaacatgatgtttcagagcttttaatcggcttgtgaaatgttagaattatttctgtctcaaaatatgtaaaagtatggtggaggagaaatagtaataccttttcctcacccagggacctatggaaaaggtcatgcctgacacctctaatccaaaagatagactggcaaattaaaagcataaaaagtttatttatcaaaatttcatgtggcatgggagcttttggaattaaagttgcaaagggccagagaaaattttttattttttttgagatggagtctcctctgtcacccaggctagcgtgcaatgtcatgacctcagctccctgcaacctccgcctcccaggttcaagtgattcttctgcctcagcctcccagctagctgggattacaggagcataaccccatgcctggctaatttttgtatttttagtagagatggggttcaccatattggccaggctggtcccatcctcttggccttgtgatctgcctgcctcggcctcccaaagtgctgggattacaggcgtgagccaccgtgctgggccaagaagactatttttattgctaagtctgatgaaagaaatggatagttgtagagaaacatgattggataacaggagtatgatctaatggtaatgaactggagacaacttcgcaaggccagattcttctctgtgtttctgtaagccattcattgcccctgggtatcaggaagcacatctgtcacatgaggatctgggaggtggtgaacgtcagagagtgatttttctaggttttatggcttgtttgggggtcaggagggggcgatttctcattcctgtgacctgcttgggggagaaaaggatgttaagttctcttatgggagtttgcagatactgttttgactctgaatatagagactttataactaagccatggtcctcaaatcaaaagtaatccgtatgtggtaatctggagaggtgtgtaataattattcttgtagattcagaccatcctaaccataatcaatgctgggcaggtaataggagatgttttatggcaaatgattcagtcaatgttccaattattgaagctctatgtaggagaaagacaactgtagatactggtttgtctatagatccattgaaaaaaactggggtactgacttgttgaccatgactcatggggacaagaccacaactgcagcttagtatctaattatggccataagccaccaactacttaataattgtctatatctagtaaatatggcatatatgtttacggtatatacctggactcctagtattctctttgagccacttttttgatttattaattgttacttgctttgtgtgtgtgtgtgtttgtgtgtgcatgcatgtgtgtgtgcatgtacaagtgtttaatccattagtctcttagcatataaaaatgtttttcttgtaaaaagatgcctacctatttagcctgtgcagtggaggaagctgggggaggtagatcaagtacaactgagaattttgtgaggattcaaaggctcaacatttttacttccttgtgagcctttctgccttgcaaaggtcaacacactcacgtctcttccccctccagcaatagtgttttcagatatgagcaaaatattttacctcaagtttcaccattttctttttttacaataacagaaagcagatttttattcagagtacacttacagtggctttgtttttcttgctttgtagaaaaaaacagcatttatttatttattcattttgttgttgtcagagtcaaaatgtaaatttcttcttccatttactttgacattgcactgtatatgtactatttttgaaaagagtggcatattctgtgaacaggtctttcagagacaaaggaaataaaacatggagaacaatgcaagtttcatcctctgataatgggtagatggtctacggccataccaccctgaacactccccgtctcgtctgataatgggtagatgttctcaaaaggcaaagtatatgaaaaactttaatgtaagaagaacataacataacttttatatacaattatataattcaacataacgttaatcatcattttattagcacttttttatcattgttagatatagaaacatagatgcattaatatatacataaacatgacatatttctacatgcacacaaatatggagttaacgtttatttagaatctactaatatgcttgtggtagaactacaaagatgaattatatgaaaatcttatagtttagatggaggtaacttaaactacacataaaattcctggaatagcgccttccatgaacaaggcactcaaggaaaatttgtgcaataaatgaatacataaaacaacacaagtacaaagcagcatgtgctgtttggtaagctaaaatgcaccagaaggttcaagagttaaaagacatagaagaagcctgaaggcaatgaaactattgatgtatttgcagagaagttagtcattgaagtgtccaagcaggcaggtgcacatgcactgggatgcagctatgcaggttggaggaggcaggctccgcagatagggagagaagaaagcggtgtatctgattttcttttcttttctgtttttggagagagatattgaaaatgaataaacagtccagggcatagaaaagtttgtgcaataggggaaaataaagtaaattcaagggaaaataatagtctaaggtctcctataaaaatagtctagttactaggccaggtgcggtggctcaggcctgtaatcccagcattttgggagaccgaggagagtggatcacgaggtcaggagttcaagaccaccctggccaagatggtgaaaccccatctctactaaaaaactacaaaaattagccaggcactgtagcaggcaactgtaatctcagctactcgggaggctgaagaaggagaactgcttgaaccgggggcagcagaggtagcagtgagccaagatcgagccactgcactccagcctgggcgacagagtgagactccatctcaaaaataaataaataaataaatataaatagactagttactgatgagtatagctatttacaaagggacacataagacgtttttgtcttttttttttttaattttttttttttgagacagagtgtcgctcttgtcacccaggctggagtgcaatggcaagacctcggctcactgcaacctccgcctcccaggttcaagcaattctcccgcctaagcctcacaggcgcctgccactacactcagctaattttttttttttttgtatttttggtagagatgggttttcgccatgttggccaggctggtctcgaatgcctgacctcaggtggtcctcccgtctcagcctcccaaagtgctcggattacaggcgtgagccaccgtgcctggccggacgtttttttttaagagaaggacagaagtcaagttatgtatcttcttaaatagggaaatacattttacttcctctaccattattactattttttcaaggttcctaaaatagttgtcattttacataacgttttcaaacatctgtgacagatcttgaaagcgtcactatgcgtttccttaaaagaacacccatttcagaacccgtgtcgtctctttttcttccttttccacttccacgtccatgcgatcaagttgggttcaagctgccgctgcggcctgtcttgaacccacccattttcctctaagctctgctgccctgggcctactgactcctgtcctctcactgtccttactgctgtcctctcctgggctgatggccgaaaacgcctccctcacgggctcctcaccctaagtaggtaggtctctcccaccttccatctaattttcacagtcccatcagaattttctttataaaggctggtatggctacctaagttcccgttattgcccagaagataatcccaaactgcctaatatggtattgatagctctcaaaatggggccatcgagtaccccccttacactatctcccattcgtttatcccatctacaccgagattcagtcaacctgctttgcttttcccaaatagtcaaagatgacgcatgtttcccatcctctgttctgtgctgttcattcaagttttttccttgcctggagtatcctcctttctttcttttagtcagaaaagttctattcacatttcaagatccataaaatgtcacgttctgtttactcacttattgtaaaaacgtgtactctcttaacttcgcctttctatttatacacaacttacatgtacgtaaatgtgccttctcccctccccgttacacccagcacacatattgcctagcacacagtaggttcataagaactgttgaatgaaattttcaaatcgaagcagatataacaacctcttattttttttaaaaccacttttgtcaatttattcagcctaatgaatatttttctatatatctgccatatgtatagaaaagtttatacatagtttctttatcaggcctaacagaataacttttactgtattaaatagtaacttactcaacttgtcaaactggagaggcaattgatttgagtattaggtctttacattgcatcaaccaagttgattagtcatttttaaatttatcattagttaacattaaaaaaaaagttaaaaacaagcattgctcaagcccccttgtttcgtgtttggcacactgcatagcttttaataaaaagttatttttcaacctgcagtggaatatttaaacatccatgcaaagattttttttttttttttttttttttttttttttttttgctaaattttcaaagaacatcagaaatgttgtattaaaaaacagatgatggggcagtaaagacttttttatttggtagtagaaacatatggggaaataaaatgtattaatgttgtaattataacattccaatgtttctgctttctcaagtttttatactaaaaatctttcaatagaacataactttaaagatagttttctttatactaggttcatgcatttgtgtcccatatttcaccataagggatatttgtaatatatttctggaatgggaaatgggtcaactatctagctgtccagtatttcacatttatgaacagaacccccaaactgaaaattagccttgggtgtttcataacttaggaccaactcagaaatgtaggctttggaaagcaaataactgtgatccaattttcgggaagcaggtttgtcttttatggcaaagaagagtgatcccagttttaattacaggcattgagtgtccctagccaaaactcagtctgaggtgtttcagcatggaagatcatttgggaaagctgggtttgcagaaagcacgagcaataaagacataacatataaacagatattctgcacgtagtttgcaaaatcttaacctcatcaaaagaagagatcaaaattctatttaatgcaattggagattaagttgcagagtacaatttaactgaaatacagtaccacattcatacttcaaatggtttatcaaaagaaagactaaaaaagactggttatgtgtctatataaggtttgctcttctctttctctctctttaattaaaaaaaatatatatatatataatatatatgtatatatataaccaaggcaaaaagtaagaggttgatgctctctgtccaaacctctcttctctctctttttttaaatatgtgcttaatatattcctatcttcccaatattttaattaagaacaatgtttgcacacatttaaatgagtgacatctttgcttaaatttgtttttgactaattattttccacgtgttttcaccttccaacactaccttagtcctaagttatgaaatactcaatgctcttcataaaatatcttgaaataactttttatttcaaaattaaaattaaatcacataaaagtatgttcttaaatagactatagttttcttagatcttgttgagattaaaaacaagtgtgatctggccctggccgggggtggtggctcacgcctgtaatcccagcacttttggaggccgaggcaggtggatcaggaggtcaggagatcgagaccatcctggctaacacggtgaaacaccgcctctactaaaaactacaaaaaaattagccgggcgtgttggtgggttcctgtagtcccagctactcaggaggctgaggcaggagaaatgcttgaatccaagagttcgaggttgcagtgagccgagatcgcaccactccactccagcctggcgacagagcgagactccgtctcaaaataaataaataaataaatgaataaataaacaaattacctttaacttagtatgaccattttggattgctgtaaaatattccataaaatagtaagagccttcaaatgtaacttagagtaaatgggcaaatattatttttcctatttacagagatatctaatagcccaaacaaatatttgaaatcaaagttatatttgaatgcatttctgaatagatgaagggataaacagatagtaatataaaggagttctgcaatgctatgtctatagacctcatgccaaaaatggggacatgagtcaagtctacctaacatgtttctattttctaaaaaaaaaaatttaagtactttaaatgcttatgctttgaataagaataattgccatttcaaaaaatgtaactaaatatgtatgcatgcatctgtgtgtatacagagacaagcagtgatttataattttgagaaatacgatattctgattctgattaaaatagctaaaattcacaaattcaaagttgtgaaactaaaaaagaaatttttttagacttgtggattaaaatcttggcattctactcatttaactgtatttatctatggcattttcatttggcataattttcatatattttgtaataatatcacattggctgcataatatgaagtcccttgaaagaaactagatttcaattctgtggaagaaataatttatgatgtaagagttgtgattatacagccaatatgagttaattctttaaaaaaaaaaactaaattgatcaagcaaaaaaatgtactcacttgtttgagaatgtcaatcattttcaattaaattatctagatgtttcccaggtttcagctgatatatttttcttaggaaataatattttatctcattaaattatttctcttgaatacaaaaaatctttatttagccatcagaccaaaaataaataaataaatagggacagctcagaaggagtgagcatagttctttctcttccaaacatacaggtggaacgtatagtgctaacagggaatattctgtgacatcataattttgggcactgaattttgattgcagtgtgttcttcagagtcaggcacctccaagtctgcctcttaatactgccagctgatgcctctaagcctcagttttcacatcagccaatgtgaccactattacatacgtcattgtgctactgtcaggatgacataaagatgctgcatagaacacgtttagcccaaagcctggcacgtgataagaatacaataaactatacctatagtcagggcaacagaaagacaagaattgatatggtcaaaatcataaaccctctttttgtcctacggaaggcacaggcaagaatttggatgacacatggtggtgcttctgcccttactagtgacctaaaaccaatctgccaaagtataatgattgagttttgcagaactgttgctaagagatatataggtgtatatgtacatgtatacgtatataaacatatacacacacctatgtatatataagccatatctacacacctatgtatatataagccatatctacgcacctatgtatatataagccatatctacgcacctatgtatatataagccatatctacgcacctatgtatatataagccatatctacacacctatgtatatataagccatatctacacacctatgtatatatataggccatatctacacacctatgtatatataagacatatctacacacctatgtatatataagccatgtctacacacctatgtatatataagccatgtctacacacctatgtatataaaagacatgtctacacacctatgtatataaaagacatatctacacacctatgtatatataagccatatctacacacctatgtatatataagccatatctacacacctatgtacatatcagccatatctacacacctatgtatatataagccatatctacgcacctatgtatatataagacatatctacgcacctatgtatatataagccatatctacgcacctatgtatatataagccatatctacgcacctatgtatatataagccatatctaagcacctatgtatatataagccatatctacacacctatgtatatatataggccatatctacacacctatgtatatataagacatatctacacacctatgtatatataagccatgtctacgcacctatgtatatataagccatgtctacgcacctatgtatatataagccatgtctacacacctatgtatatataagccatgtctacacacctatgtatatataagccatgtctacacacctatgtatataaaagacatatctacacaactatgtatatataagccatatctacacacctatgtatatataagccatatctacacacctatgtatatataagccatatctacacacctatgtatataaaagacatatctacacacctatgtatataaaagacatatctacacacctatgtacatatcagccatatctacacacctatgtatatataagccatatctacacacctatgtatatataagccatatctacacacctatgtatatataagacatatctacacacctatgtatatataagccatatctacacacctatgtatatataggacatatctacatacctatgtatatataggacatatctacacacctatgtgtatataggacatatctacacacctatgtatatatataggccatatctacacacctatgtatatataagacatatctacacacctatgtatatataagccatatctacacacctatgtatatataagacatatctacacacctatttatatataagccatatttacacacctatgtatatataagacatatctacacacctatgtatatataagacatatacccacagcgattttctatcacgttcgtttttaatcaaataatattagtcaaaaataaatacgtgtttgttttattattcctttgcttagttcctgccagtactagctggcttttctagtggaaggctgatcactttttccataaatccatttaatccaatcagtcttggcaggattgagacatgttctcagtggaggtcaagatcttgtttcctggtcactaagagcatgggataatagtaaactccagaaccatttgtaaaatactgtcagtcagacaaatccaaatacctgtcatgtgcccagtaagttattgaactttaagagaataaagtatgacccttattattgtgtttctaatcttctcagaaagggaaaaaagactatatataattagtgctcagctgtacaattcagcatataagtagaaattatttcactatgaaatcagataattgagacaaaattttagattgagtgagtaataatagccttatcttcttttgccctttatcctcttcccacatttaaactaggaagagaaatgaaacaagtcacctgtggatgttattggagagtattggatatgattctttgctcttacctggtgctctttcaccccacccctaactttctccttaactctctggcaattccatgcaaggccacctaaaatacccctttctcaataaagattttcctgaattcccacctaaaaataatttcttccttctctgcctttcatagcactttatgtgtgctgctccatttgtgacccatgtgtattctgttttagttatttatcaggggaaattcagccagatatcgggcaaaattcaccctcgatatttcatgtaggttcttttctgttttccctaagcattggccagtttgggaaataaagggacagagtacaaaagagagaaattttaaagctgggcttccgggggagaaatcacatttcgggaggttctgtgatgccccacaagccgcaaaaccagcaagtttttattagtgattttcaaaggggagggagtgtacgaatagcgtgtgggtcacaagagatcacgtggttcacaaggtaatagaatatcactaggaaaatggaggcagggcgagatcacaggaccacaggactggggcgaaatttaaattgctaatgaagtttcgggcacccattgtcattgataacttcttatcaggggacagggtttgagagcagacaaccggtctgaccaaaaatgtattaggcgggaatttcctcgtcctaataaacctgtgagcactatgggagactggggcttatttcatccctacagctccataaaagatggccgcacccaagggggccaatttagagacccacctcagtgatgcattctctttctcaaggatgttccttgctgagaaaaataattcagtgatatttctcccatttgcttttgaaagaagagaaatatggctctgttccacccggtcactggtggtcagagtttaaggttatctctcttgttccctgaacattgctgttatcctgttcttttttcaaggtgcccagatttcatattgttcaaacacacatgctctaaaatttgtggagttaatgcaatcatcacagggtcatgaggtgacatacatcctcctcagtttacaagatgacaggattaagagattaaagtaaagacaggcataggaaatcacaagggtattgattggggaagtgataagtgtccatgaaatcttcacaatctatgttcagagattgcagtaaagacaggcataagaaattataaaagtattaatttggggaactaataaatgtacatgaaatcttcacaatccacgttcttctgccatgtcttcagccggtccctccgttccgggtccctgacttcccgcaacagctatttcataatattagggattgtatggctattcagacgtccttcttgagggcaggctctttatcttttcctcacaacagttagcagtgtcatggagatagcaagtattttatagaaaatattgagtgagtccatgaatacgttttaattatttgggtacttaaatgtagaaggttagttgctttaactgtgcttatacaatggaaaccctgttctctgtcaaaaaaaaaaatgtgaagatcttgaaaaatgtggagaaactggggagcagctaagtggctctgaactagtcagattaggctcatctatgctgtagtaacaaacaagcccctaaacctcaatggcaattgatatttatttctcatgtgatctgcctcacaaatcattgcaggaaataatgttaccaatgttttggctcttcataaaacattcattattttctctgtcttttatatagttttctcacccacctctgctcagcccctgtgacaatgtccatctattgcaggtggtggatacaacagcagcccacttatggtatcagtttatgtttcagtcagagtagaataagctatgctgtggaagaaaataaatgctaaaatttcactggcataacaaattaatggttaatttctcaatcatgcaagtccaatgaaagtgtactaggtggcttttctccatcttgtggctgtgccatctgaagaatgtgaccttaagatcaccacacatggaaggaaagacctgaaggaccatgtgaataaagggccagattggtctgtggccatatcacctccactaaatccattgccctcaatccagtcacatgcatcctaacctcaaggaaaactggagaagcacatggatggatacctggtgagaactaatagcatatgccacagattctatagtggcattagaagttcacctaattcttaagtcttgtttttatttattttattatttatttattttttgagatagagtcttcctctgtcacccaggctggagtgcagtgtcacttggctcactgcaactgccacctcccggatttgagcgaccctcccacctcagccttggagtacttaggattacagctgtgagctaccacgcctagctaatttttttggatttttagtagagatgggatttcaccatgttggtaaagttggtcttgaacttctgacctcggtctcccaaagtactgggattacaggtatgagccactgtgccccgccctaatttttaaatttcaaattttaaatttttaaattttaaagtctgatttttaaaataccgaaaggtataccctccaatttctccctaggaatatgccctgtgttagtccagaagatgctgaaggcatatttgaggggttaccatgggggcattctttcatctgatcactgcagatttctccttaactctgtcatgtctcatcagtgtagactgacccacacttttccacaccatttacctctctggattggattgactattctttatctcatttttaacctctcctcatctgtcttcatggagatgtagttttgtgttttaacatctctaagaatatgttttgttaatgtaaattatattttacatatcctctgtactctattttatgtatcatatcctctgttttttaatattatgatgcatactataatgcctcttacatgatctaattatagaattttgacaagtacactattgaaaatcagcctcataattaacagatattactttattttgctgcaattaattgttgcctgctttatcttagcaattatttcttggatggcagaattggataatctgtgttgccacatgggaatatctatgtaaatggcaattaaatacatcctattaaagtatggtgtgaaagagatagatttaagttgggaaataacttccctgtgaccttagagagtttctggattgatcatcagataagtctacaacagatgccaaagaaggtagtatcagtttaagagatttcattcagctaaacacatataataaggaagactatttccaggagctactatgtacattaaattctattagtgatcatcaacaaaatttattaacataaaaataataaagccatctgaagaataattactgcctattgggagaaaaaaatagaaccatgaagaaaataaactctgccaacttagtgattttcgttaagtaaccaaacatttctactttgtgtcttccaaggaaattctttcacttatcaagtgttatacatattctttgttctaaaactgctctattcagctgtcattctatgattttgttttcaaggttgccccttctcttcttactcattttaattcttttctctttgtacttagattaaaataaagtcaattttaggactgtgaggtaagaaaggaagaatttgaaagatgcaacgtccttgtttatagtagatatttcaaagaaaaaatgtaaaattctcgttaatctaagaagactcagagaatatacaagatttaaagaactatctttaataaactattgggtagcattgcacactcagggcttacaactgaaaaaagaatctggcaattttatgcatgaaaaaagcaagagtaaactaatggtctatatagcatttcaggaggtgggacggttctttccaggttcatgtaaagctgaattggggtaatatctctcccctccacaaacatccccactgggccttcacaaagcctgtgaaacagcaaacagttgttttcctaagtaaatcagtatgcagtatcaattttaatgaaatcctttaaaaatatttataagacatactttgtgagctggctcttgaaaagtgattagggattgaatatgtggagagaagatttttcattttgttttatgtttttgaaaactaatgagaacaatgtttgaaaggaagaaggagtaaggtcagcagagtgggaagataaggcaacccaaaactcatcaaagagctaagcaaatggagggcgaggggcattccgtttggcctgttctcttggataatttatgaagttcaagtcacagaactgggaataaactcccaaattttcaggttctgtgacccattcgcttttcactctgctcctctcctgcgaactaaaaagacctcgaattttaaaatataatcaaaaccccccaaaacttaagaaagtgtattctcctttcagccatttaaaataggaaaacaatgaaaagaaagcctcccttaaaatctgaacattcaaagctttcagttaaatttatagatttattcaagaagagttgtcattctattaagttagaagttgactgttgtactgcctcctccaactgtatttgattccagaagtcacagagtatttacactttgtggttcttctttctgtcgctaatccacataagagagatacgtattgtcactctattaaacaacttatttgtggtttgactgtgattttccctgaaccttatatgtgtttcctttcattatggttagaatcttgggcagatggattttttcttatccatccctgcctctgttccacaggcacacaatatcatccttacatatgtaaatcacattaaactggcaagcttccctaccagactggaccctgcagggagcagggtatgtgccatgcttatttctgtgtccctcactaaacctaacacaggatcacacagtagagattcaacagaaatttttgaatatgtattatgttttttaaaccacattgaatttaagtaattgcttattatgaaaacaataactattaattacagatagttgcacaccaaaaagggaaaaagcaatcttttcaaaactgtcgtatgactaaattaaagtcctaatctattttccccttcatgttggtttgtagatgtattctcagatcaaatactattgagattcaggaaagcttgtgtttggcaaggtgaatcattgactgcatagggctggcagccaaaaataaaatagttgattgcaaataaaatgataggctaagaaatctcagcagtgcacttttggggtaagactatggtttgaggagaaatccattgggaaaagtcaacctgggcatgatccaagcaatgaatgcctttagtagactagattcagcaaatgaaactgagtgatttcaaatggaggttcaatgtgaaagtcagagaatggggagagattgagtttatatttttcatttccagccaagttatggattagagtgtttcccaggaagagaagtactagctggggttgagaatcaacttctaggactgaaagaaacttgaaatactaggcaagttttatggtagacagatctaccataaagttaagaatcaaagtggaaactcaattctgtgaacttacccagcacaggatggggacatggaaagccatgattgggagctatacagaaatctgggaattgctgtgatccctcagattgaggtttccaagacaaagaagaattggttaggtggagagaagtggagacacccggcactcatgctgggtcatgctaagttaaaaggaccatggcttcattccaagtctgactcaatggtaaagaaacagttgtaccacttccttagtcaggctttgcacatgaactaggctagagctagagtaaccatcttatctgttttacataccagttctcttttgaatatagaagaaatcaccttaataattatgtctggaccatagtcaaaagcttggattttctaggcagactgagacatattgtcacctagagcatagtctattgaaggtaatgggggctgagtttcagggatctttctgaaaggaccggaggtgatagaagtaggagagattgggttagttttgacaacaattatgtcttatctacatgtgaaggctatttggcattccttaccagaaggcactaatggctaggttaggtgggaaaaagataaagacaccctgccagtggttttctggaggactgtagtggaaccacaggaggaatatgctggaatgaaattcttcacgggcatatccttttggatttcttagtcaatcatgaattagatgatcaggagatgagtgactaagtctataggacgagaagaaagagacccatcaagatgcacagcaactccccatgattagaatcatggaaaactaatgcatatagatcagggtacagaagataagatgacttctcttccccaggaaaatccctaaagtgaccagaataatgtgttttctccagtcttaagaatatatatttagggaaatgacatttgtagattttccaccattgccagtctacatagttgagaagaagcaccaatgttatcatgtattttattcactgaaagaatcacagagattcaatagcttgtgtttccaagcattatgggagactgcttaacaagtccagaaatgctgaataaaatatcacaaacattcttcagatgagattctaaactgctagaaagtaagggacctcaccggagacaaaaaagagagagagagttgaaaacctgaggtacacagcacattcaacatcagactaggctttgagcaagggacaggagagatttgggaatgaggcactgcccataacatcagagcccataaaaagtgacgtgctcagtaaaagggttgacttgaaaaaatttgttcattgccaaaaagataataaagatgtctggactggggtaggtatcaaataaacaaactaaaacgtgtttgagactcttgctatgaatatgacctaatggcatttgccatcttaatttataccaaatcccttgcatgactttgaaccccccaagatgagaaatgaaccgaaaaataatcccaggatggtactacttatctgattcttggccaaagcaagcacaaaatctccctggaggaacaaagttcataggacttctaaacaaatccccctattactcatgtttctaccagtggtcccctgaagaaataaatatgcagcctcaggaacattttatgaattgcaattttaattctggtttgagtccctatcttctttgcataatatctttggctccacaccttcctgtgctatgattgctcaacaaaataaagataatttagaagtggacagagtatgcaggggcttactgaacaacagaaaagtaatatccttctatctatggcttatttttagaatgtgtccttaaatttcagtgtttgtcattatcattcacagagcttatctgtattgacctttactatcctttttaacatcttaaaagcttcaatcatatctctgctcttcaatgtcttttcttcaattgttgtaatctcagtttgtctggctctcagaactaatataaccttctttcccatttatcattctggtcccgtcaatcccttctgcctcctcaatgtctttcctgtgacattattcctttccctgccgagggagattgtctgaaatggtaagtcactgagtgtagattaatcagctaccattacaatgtctggcttcccaagacatgtttgtagcctatttcataaatttgttgttcttaaaagcaaacctaatttcacaatgaaactacccaatccccttttcatcaaaaaccagggtaaaaaatgtctttggtgtaaacaacactgttcagctactgtgatctaattggagttagtttacactgtgccttctctaaaatcattcctcttggaattcttattatagtgagcactgctttgatcccttttagtctctttttgtcctccatttcttccctattttgtcctttctttactccttagagagtgcacattcctgtaacataaagcaagctgttggtaactacccctggtattctgtgcacaataatctttgtgcagtgcttttattcttcacgcttgatgtgtggaacaactctgtgatttctgctaatgcccaaataatagtttcctcaaatgctaaatgccatgctcaagctaagataagacgacagcggtcagaataagagctcaggtcttctgatgcttacttttttcactaaaccaagaaccttaaaactagagatctttttgacaacttaatctagtatggaggtattaccaggttcttgctaaggttgagaaattccctttttgtgaatacaagaactgtatttgtgtgttatttgtatatatttgcataatgatttcaaatgtccaatattcaagtacacaagttgaaatgtagtaaagctactgaagtctacatgattcttttaagaacttccttttagagcatctaggaacatcctcatcatatgactcctgaatttctactttctattttttatttctactttccctatgatctctctttagcaatattccttttttttctcctagcttcatagatatatactatcaacttatatatttatatatttaaattgaatattcaagcaagatgaaaggacttcaattctggtaaggaacttatacaaaactaatcttacatagagttaggggtgggagagaataatagcagaaggataatgttcactaagttactgaccaaagtctgtactaggtatatcacatacccattcccagtagacaccttcccttctaacagtcatgaaaagtagtaatatttcacttattttacaagaagcacaaagagattctgaagataaaatgcaattgttaataaatttaaaaggcaggattgaaacccaagtatgtatgattccaacgctagcgccctttccactgtatcaggctgcgtcatgtgataggcatcaccacatatgacatggtctcaagttgctgagcaggcctgggatcctgatcagtcaaccaacatgcattggactcaacccacatatgggatgctaacggatgagactcaatctttccaatcaagaaacttacaatctcattaggaaaacaagtatagcagatatgatatgattaacaaacattgcatgattacttcataatatgcatatgtggggacagggggtatataagaactcttaactttctgcttagttttgctgtgaatctaaaattgctctaaaaaataaagttagtttaaaaaaatctgtcagagttgagtatttgttggaattcttacaacttccaaaacaagtaccctctcgccaatcagtaatacaacccaatgcatacagaacatcattttaaggcagacagggccaccacatacagcctgtgatctaagcaatttttaagaggactttgtttctcagcaacttcagtgtcggcaggctcccctaagtgttgtctcactcagctggatggcatgtgaaccacaaaatgaagtgcagcagctttgcaggttgacttctgcaagaagtgtgaagaaatatccgtggatttgcaagaagtgttaaaaatatcgcaatcggaatattgtcaatcacttctaaatagatactttctcaggaaacatgtttcctttcttgtttctcactctctcttgtggctgggcaaatgtatagtagtttaaggtgttgcaagaggcaaactccacttaaacctctttatttccctagctgagactttgaagaatagaccataaggagcttggggagttatgtgctatttagttttcttcctgacatcttccttttgacttactgcagattttttttttctcatgccaatatatttttgtatgttggatctcactgaggacaaacaagaaacaggctgtgctaatagaaccaagctaggggatatttcaattcagtgttcagctaatagatttagcataatttatcataggcataatgtacctccgattgtatataaataaaattagtccttatgttgaaaaaaaactgttatagtatatgtgtaccttgcatggaagctaagaacccagtttcacaaatgctgtctcaccccaatgacacattatattgaaaaatccaaataccaagccatgacattcaagtaattttcatgaatttaaatatgctgatcaattactcaaaaaatattccagaggaagactatggggttctgtttgattataaagtgtcagaaatatggatctttaagaaacaaaaatcacccctcaattgcaacaataaatctgaaagtctatggcagaataatttgcagaaaacttaattgggcttccatctcttccttctcttccacaacatagacccaaataggtaatgtgcagttttactgtttcctaaatgtaaattccatactcagattctgttttttttttttcctgtcttaagatgaggatttgaagttggccaaagtgttaatcttctagatcctttccttcaccagcaagaatctgactgtagctgacccttcatgaatgctgcctgatttcatccaccatcacattctctatcagtaggctgcaatttatgagttgttcatagaaaagtgaaggagattaaacaaaaatcctactgatcatcctggctacttccaattaggctgtctccaaattgtgcttcattggggtccagaagaggaaatcaactatacaatcagatatttgggtgtgatagtcacaggagcaaagcatttcctctaaaacacaaaatctgattgtgcaattccctgcttaaattctttcattagcatcatcacccctgttttcttcccaaaccctattatggtatggtttctagttagtttcagtatctaaatctagattcttctgaggcagtggtgctatcatatcatatcatatcatatcatatccttgaaacctggaactcctgggctcaagggatcctccggcctcagccaacctaatagctgggattacaggagtgagccacattgcctgggtcagtatctcaattcttgctgagctttgcctgaaactctgctcctggcacaccaatttctacaggctccttcacaatttcacacctgtttcgtctacctccctgttcctcagccctaaatactggtcaccctgatcttctcctgtccatgttcctaaacttccagttcagcaatcatgcttgactttcctgagcaccttttatctccaggtaaaggtgacccttcttccttgtgccctaattgctgtttttgatcagtgatcattgagccacttaatttgtaaatttcttgaaaatagggacacattcttaagcatcttatccatctccgtacttccaactcttgtaacagtgcctaacacattagaggtagtgaataaatatttctataaacactgttccaatgaaggaataagcaaagaagcagttcatctatagaaagcagagattacgtgagtgtatctagagacagccttttgcatgagtgtaataaggaactgtctcctttacttacacagtatgattttaatagtcttgataaaagtttatctgcataaaagttatcttcttatattttatttcaataatctttcctttttgtaaaggcattagtttcaatcattaaaatgcacaaaataaataataagacagtgctaaaaatgggggaaagtactgaataatggttcaggcaacagggcaaacagaccttgcgtgtacccaccaataatgtaataataataacaataatgacatctagaagactttaaagacagtgacaggaaactcaacaggtgttgtaattaggtcaacatcaaagtagttaagttcacttacactgccaaaagtatcagttttatatgtctggaattctaaagccctaaggggtcaaggaatatggccttacgcccagggcaggtgggagactgaaactgatttggagctgtttaaggatggcccgagtttataaaacagaacatagatgaatctggccaacaagtagaagatgacaaagaagcttgtcatctacctcactgtttgtgaagaagcaatttctcatgagaaactttaactccctgtctgccgttgtgcatggaagtgagatctggatttgctctataccagccaaagctaagaatataatatagatatgagtccaagattcacaaaaccctgggactctagcaaaagcaacttaaaactactctacagggacatttacacaatccagggcacatggcactcaaagagtaaacaactccaaccaaaaatgacttctaacaaaaattacattcccctcgaggaagtaagtcacaataagagagagtcagaagatgcaaaagatgagaaaaatggtgccccaaggacaataaacaataaaactgatatttcacatttttgagattcaacgacattgaatcacatagatacgactaggactttcattgaagaaaaacttgctgtgaagttgaagatgaagttactgtgatacataacatgcctcagtgatttcacaaggcttggcttatcagaggtttgtttgattcaagggaaattgagaaggtatgtgtttcaaaggaataggtcagaaagcttttgcagcaaaagtgcctacttatgatgacctctatgggagtctgttcaggctgctataacaaaatagcttacactgggtggcttataaacaagggaatttatttctcacagttctggaggctgggaaatctaagatcaaaggtctggcaagttcaatatctgatacaagatgacttcctggttcacagcacattcttactgtgtcctcacatgatgggaagtactatctggggcctcttttataagggcactaatcccattcatgagagcactgcaatagcaacctcaaagacattttacaatagtggctgcatgatattggaataagtggaacttcttagtgcccatatttacttttgcctcctcagccctggattaactggatatggcttcagtttgactcttcacatacacatttactcagactaccaagtttttattgattgatttccacgtggctgagtggtgccccagcccttggcctctctaaaataattgttctgggtctatattccctttgctttgctgtcttctatgagtttatgtctgcagggtaagataggaggctatatatatatttttttaaatttaattttatgttttgaaacaaagtctcactgtgtcactcaggctggaatacagtggcacaatcatggctcacggcagcctcaacctcctgggctcaaatgatcctcctgcttcagccccctgtgtaacacacaccgtcacacctggctaatttttgtaatttttagtagagataaggtttcaccatgttacccaggctgctcttgaactcctgaccagcctgagcaagactcaagtgatcctcccactttggcgtcccaaagtgctgggattacaggagtgagccaccgtgagtggccaagggacaggaagatttataaacatcttttgcttaaagttacttctaaagaaaatccatgttccatagaaaagtggatatcaaaacacaggtaaatactatttcctaatagcaacagccaagagatggttcaggaacatcattatgtgtaatcacaacatgcccagagtagtctagataatctgacaatttttgccttaccacacatggctctgatctcaggcaccttttatatttagagagtcagctgctttatcccaattttttcttttcttttcttttctgttctctcctttcctttcctttcctttgtttcttctcttctccctcccctctcctccccatcccctcccctcccttcccttcccttccctttccttcccttttcttcccttctctttctttttttttttctttaagagaagcagtttctctatgttgcccaggctggacttgaacttctgggctcaagtgatcctcccacttcagcctcccaagtagctgggactataggtgcacaccaccgtgcctgactagtttttttgtgtgtgtttattgaagagatggggttccaccatgttgcccaggctggtctcaaactcctgagctcaagctatcctcccaccttggcttcttgagtagctgaaactacaggtgtgtgccaccacacccacctttgacatttttaaaggaaattactcaaacttatctaaaaagaagagataaactgagaggttattaatattctttcttttcatggaaaaaatcccttgtatgtgaattataaatagaattaaactactgccagttatttttttaatgtgcattgcttgatacaaatcatttgtaaaatcattattagcatacatcattaggaaggcattttattattcccaatcataattctttttttttaataatctgctgagagtcacaattcagatcctggagattaggcatgagaagttgggggttggtatgaactttgtggaggacacttaagttgctcctccccagtttctgcttccagacttgagaatggggagtccacttctctctatagataccataaccagttcaaaaaggaacaatgcactgtgctgaagggatcttctttcactagaataagaattccaaaagactaataccccagacactttatattactgtttactgcatttagtcttcagaatattattttttttttcctgcatggtacccaacaatgtcatgttagtgtgtattttcttccatatgttttttagtttctttggaaaccttctagatgctgttttgtttagagtgttttgtaggaaaggaatttacaccatttataatagttagaacaagaaatgtttatatgatgtgaatgaattctctagagagaattttacataactgcttcattttaatttcgtaccttgactcacttttttcctcatttttttattatagacaggataaaatgctagtgaaagatcaaaagctaattaaaagtaatcaagaaattttctttctttacatttatttctaacagcaatttaggctcatatcatttgtaactttttgaaaatcaatgtttagcaaattattaccctgattctcatttagggtttaacgatttccttatagatattgttatatgggagtttatgtgtgttactgaaggcaaccctaatacaattaacaactaagatgcactgaatattctgtattatgaaacatcaactacattaaatctatagtttaacttaaccctcactgtaacactaagaaacaagtattgtcattccattttataggagctatttgcattttggattgctaatttcatttactcaacaagatgttgaccacaaaatataccccaggcactgtgctagactttagaagtttaaataaaaataagtaaaaatcttacacttaagattctcagtttattggcatagaaacaaaatacaatttaagcattctagtataaatttctttgtaaacaactattgggcttagtaacacagcaatttataccattttatctattgcttcaaccaacattaatgatccttacatgcaatggttttcaatcatgtaggtcatgtacctcagctcagaaaaaaagcacatcctcatctccagaatacgcatgtctgtctgtaactagcacagttgcacacgcattgcaaggagacttgaggacccctagaatgtcatctgcacaattctgctcacattttctcccatttctaattcattatctttatttctcttggagtttttttcatgaaaatctgatcatgccacttcctttcataaacactgcaaaggctgttgaggcctatagggtaaaaatataagctcataaccatggtgtatagagggattcatgatctgaatacaactcacctttgcagcctcatcctctatccccatctttccacttatgccatcccacatttgctatgcctattattttttgggaaatttttatagcgattgcatcctttttttttttttttttttttttttcataaaatgccttgcctacaaccctagtctctttactgaactatttactcctactgagccctcagggaatagttcaaagatcacccctctggcctttcaagagagttaatgttccctgctcctgattggctcactttcattatagtacactcagttctccatatccatgggttctgtatccgtgggttcaaccaaccacagacagagggaaaatatttttttaaaaaatggatggttgcatctgtactaaacatatagagacttttttcttgtcattattctctaaataatacagtataatagctatttacatagtatttacattttattatgtattataagtaatctagagacgatttaaagtacacaagaatgtgtgtagattatatgcaaatacgataccatttcatatcagagacttgggcatctgtggatttcagtttccgcggcgggggcgggggtctgaaaccaatcctctatggatatcgtggaacaactgtatttgtaattttgtcttgtaatcattcctgaatcagtgatccagagctgcttttgatcagagactatgcctgttgatatctgcatttcaattatgtattctaacacccggcacatagaaaaaacacagacatatttatttaatttattgatataggcaaaatattctttatctggaaagcaacttcaaagttttgcttttcctcccaaatacgcaactcttcatactacttccaagaagtaatgcctgatctctcagaaagttaatattttgtgataaaaattccgaacacctgtgcaggctgtgtttgatcagatgaccttgtgctgtctggactcaggataactgctcacagacttaaaagtaaggtatgttgagctaaagaagccagagaaatagactttcatggtatgatttgtataaataaatttgaaaacaggcaaaactaatctatggtgatagaggtcagaatagtggttatctctgggggacaatgatctctggtaaggggcttgagtgcgctttcttggatattggaaatgttttataacttgattgaggtgactgttaaatggatgaaaacatatgtaaacattccctgagctactaatgaaatactattagaactataactactactaattttttttataagtaaagctggctctgagactttcactatgatatacatcagcaagaccatcattctgattcagctctagaatgaggaagtggctagtgggcttttaaaaggcttgaaatccatttttgcaaaatttgaggcccaccgaagacccactgaagttcacccatggcccatgcactattaatttttatagatgctgtgatggtttaaaagatgttctcatatccaattctttgaaaggccatctctgaagaataaggtctaatttacctctacttaagtgggggctgcactttgtgacttgctttttttatttaatagataaaagctagtgagaaatgatgaagtgcaacttgggagactgtgaggtactgaggattatgtttcattcactctctcttggatcactggtagtggagaaagttagctgccctgtcatgaagacccctaatggagagggccacatggtgaggtactgagtcctccagcagccagttgtaaatcaacaaagcagtcttccttagaccatgtggttgtgaaaccatgtgactgagcttgcgagcagatttcccagcccagatgctgccttcagctgtctgccgccctagtcaatatctctaccataaccttactggagagcctaagccagagccacctaattaaccagccctggattcttgactctggaaactacgtaagataataaatgtttcttcttttcaactatcaagttttgggataatttgttatgcatcagtagatgtttaatacatatggaaaattaagacccagagaggttaagtcacttgggtgggatcacacatagagtcatacttgagattagaatccagattcctctcctataatgcctcactcctaaaactgttgtaaattttagaagagatatatttgtaaagcattagaaaagttttaatacgtagtgagttgtcaataatgttagattttaacttactatttatccttcagaattgacctctactaattacaacccaatatgaaataaatattagagtttatatcttcaactctagtctcgtcattaagtatgtttcataaaaaaatgaataaagagatcttccatccagtgttcaaaagcctgagactatccactttataggagagctgattgaaaacacaaagcacctctggcagagaggttggcattacactctctgtcgacgctcaaaagcttcaggaagagtttaccatctcagaggaatgagaacaggtatcatagtcagagggcatatatcaccttgggaggtagagaaacagggtttgaggaagctctcaaaaaagaaaggcttgtccttttctttgttatggaaattgtaaggagttgaaggatagagctccagaatattgccattgaacaaatagtaaaagaatagaattaggtactggctaacccatggggcatcagtggcactttcatttcttttatattctttaatttgttattgaaaatgaatctattcttatttaatttgagaaggtggaagtttaggagtggatatttaattgttttacagtgtgagagtatgtacacatttgtgtgtatgtgcatttatagaaccttgtctcaacctacaaataactgaattcagaaagatcacaatctgtgtgaaattgctggtctacttctactcctcagaccttcagtaagttcacagagagagaaaaagatgaaaaagtgtcttttgatgtacaacaaactcttcttcccttccaggtagctttgatttggatttgggttcaaaagagggaatggtggggagaaaaagggaagggaaggaaaagagagagagacgttggaagggaatacaaagaaacgacatattagagcaaattgtaataatacatatctcaattgtagaactttattgagaataccaagctcatttgacataaggcaggcatacattttagaaatctctttcatctaatatatattatccaaattaaaatgtgcttttttaaattcccatggactttattcttaagacacagaaataaacaataaagataacaaatacaccttaatagcaaatccacttaagacatattcttatactccaattttattttatattttatgatattttctaaacaacccctgtggcagttcgaattattgttccactttttaagacttcaaaatttcagaaggtttaaaaagagattaactatttgtagcctacatatgaacacaacttccttctctgtatgacaacattaaatgtgtgtgtgcgttcttcacatacagcctaagttgttcctatcatctagttcacatttggtgaacaaagctgagtagagacaagtagagaccctaccaccagctgatctgctaccaaaagatcagcaacttagactatagaaataatttacaagagacaattttaaaatcccataaagctaagcaatgtagggctttgcgggggaggtcatttctagttgcttaatggcttatcttcaaacattgtcctcagtggggtgccctgctatcttggatctgaaataaatatgctctagccaatttcttgagtatttgtgttgcaaggagcatttgaccaaagatcccatcttcaggcatccctcaggctaaaaaaaaaaagccacagaacaaaccgttaacatttttcttcaattgtcaaatagtttatatacagaatatattttttaaaatttaataaaccagcagcaaaaaggctataacaaaaaaagaagaaaaataaagagagatctgaacactggaccaggcattgcatgtaagaaagtattaaaattggaaataaatatattaaaagggatttgacttttttggttatcagtgtgataaaaattaaaatcccatgagatatcataatatgcaaactacaatggctgacttcttagaacagttgaaaataccaagtattagtgaagatgcaaagacataggaattctcataagatataagtagaaatgtaaatggaaaaaaatcctcttgaaattgtctttcagtgtctcctagaattaaatatgtatttatctgtgaccagtgacttcatttctaagtttacgtagagacaatatgtcaatatttcaatgtgtcaatatgtcatctgtgacaagcatgagaattttgaggacaatactaaaaattagaaatattccaaatgttcattaacattataaatatccatttaaaataaaatactatatagcaatgaaaaagcataaagtactgcttgtgctatagatttcacaagtataatattttgtgaaagaaactaaatacaaaataggacatagctgcataaatttccacatttgtagaaatttcaaagacatgcaaaactaatctctagtatgaaaaaccagaaaaatgactacctctgagttggaaggagagagagcaggagagttgcttctgttttttatcttagcggtggccatatgggtatatttactttgttataactcacctagctatatgcttgtaatttgtgcactattctatacttcaaagttcaaaactcagtggacaatgacaatgattacagtgatagtaactaccatttttgaatgtttcatgcctgtccattacaataaatacaatgaattagtaaattcttataataattttgctagaaacatattattactcccttttgtaaataaagatactgagagtcagaaaaaaaaagatgtaactgagaatcagaggtaacagttcagatctcccagagctgaaaattggcaggaccagaattctaacacgggtttacctgagtccaaatcctatcatttttccttcccggcctcattgttaatagacatgaatttagtttctagtgcatccaatagagcttctaaattgataaaagatcaagctataaactatataaaaccataacatcctttactttactgtagtatagaaaaacaaaatgcacctgggtgttttatgagggaagttattccacctgaaggagaatatgtttgcatggcagcattctttacagagccctcctgccttctcatcagatggctgaccccacctgacctgctaatcagcagggacctacatcctctagagatgttaagccatataagatattggttcagacccgttggattaatgcttagtcaggctgtcttctgggctcagattttctcccaattcatgtttccctttgtggatgttggctccatgctctgtagttcacttcccttgcttcctcacaaccatcccaggctctggaaatcttcctttgacttttttgggagaggattttggactagaactagtaatagtattcatatgctactactagtatttgtggttacttttaatggcaaaaaccacaattacttttgcactaatgtagtacgaagacttataggaagaaattgcttattaaacgtagggtgcctgactgaaatgagcccataaaggaacttggaggtaaaagtgatgaactctcctaagaagcaattgtccttactttaatcagcattcactgtgttaaaattccaccctaggttgatagcacatttctgagtttttgtgaggcaggtaagatgtagtgaaaaaattctgcccacttattgcccatgtgaccttgagaaagctacttggcatttttttgtttgtttgctttttgttttgttttgtttgagatggagttttgctctgtcgcccaggctggagtgcagtggcactatctcagctcactgtaacctccacctcccgggttcaagcagttctcctgcctcagcctcccgagtagctgggactacagatgcacgccgccacactcggctaattttttgtattttagtagaggcagggtttcaccgtgttgcccaggctggtctcgaaccccttagctcaggcaatctgccacctcggcctcccaaagtgctgggattacaggcatgaaccactgtgccccgccgccgcttggcgttttaaacctcagtttcctcatatatagagtgagggtaaggatgtctaattttttgcctctgtaacaatttaatgtctaattcttatctctgtaacaatttaatgagataaagcatgtaaacatgctttggagtattttatgttttcatgagtcaattcaacatgatctgtcaaaagaggttgattgcactttctcctagccaacagatttctagtgaagtgtaccttgattgtatctgaggctgagcattttcttttaaaaagagctttgtaaaaatggcaatattctttatcctttacttaacagcggtaattgaaacagagtttcatgatccattgaaactctgaaaatgatcagcttattctgtgggtgttatagttgtgagttgagttccagttagattttataatatatagaataatattagtattactatcatacctaccattcatggactttatcactattcttatttatttctcaaaacgatcctaggaggtgctttttaatatttacattttacaaaaggagaggaatttggaatcctgcgcaagagaatttaaggaaattgggcagctaatgagagccagaatgggatttatattgagtttgtgtgactctccccacatggagtctatctgcatatcccatcctttgtttgttacaaatctcaataggagtagcatctgaagacttacctgtgtgtatgcagtgtcatgataactagttgagaaataaattattggccagacgcggtggctcacgcctgtaatctcagcactttgggagactaaggtgggtggatcacttgaggtcaggagttcaagaccagcctggccaagatagcgaaactctgtctctacttaaaaaaaaaaagaaaaaaagaacaaacaaacaaacaaaaaaaccccacagaattagccaggagtggtggcacatgcctgtaatcccagtaacttgggaggcgggaggcaggagaatcgtttgaacccaggaggtgaagctagcagcgagccaagatcgtgccattgcacttcagcctgggcaacaagagtgaaactccgtcaaaaaaaaaaaaaaaagagaaagaaagaaagaaattatttagttaatcactaggttattaagtgtacatgtgaccataccataattttgacagatttcatattttattcaaattgaaagtgggtttatatttatattctgacaaaccaatttgattcaacagattattcacgggaataatcaaactagtaatttgatttaagaatagcaataatatatttgatttgaaatgggactcacattttctaaaatcagtgccaaacgtttctcccacagtacacaaatatgcatctacaaatgtctcacagtggctctctttggatctcctgcttctctgtgcctctaccaatccacctatctgggatctttttcctccccagtgattgtgggcattattctcttctcagccaattgttttgacataacctaatagatatttaactgaattcctgaaactcatctcttgttttcccatcaattaccacgatttcagggctaggctagaccagggcttctgaagcattaattatacatatgcatcatctggggatcctattaaaatgtagattcttactcagcagacatagggtggggctcaagcttatgcatttctaatacagttttatgcgatacctttgctactggtccttagaccatactttgagaagcaagggtatacatacaccacattaagtaatagactaattcattataaagaactttgatttgattgctgagaaacctggctttttatcccaacctacaggaattaaccacataagctaattaagtcacaaattccctaggttttcatttcattaagattaaatgtgggctctatctatcttagtcactttccctgctctaacatggaattttcacattaaatataacaccactactagttacactaagttactgagtatctaccatatgccacatattgcaccagaagctacgcctgttatttctttttcatcttcacgaagactccgtaacataaactccatggcatcattttaaaataggagcattggggattacagaataaacgccttttccaaggccacagggtgattggtgctagagccaaaattttacttgaatgatttgtaattttccatttaaaattatattttatatgatttattgtctagtttgtaaaggcatttttgtataagcatatatatttgatcttaatgtcacatatttatttgttaacatcttggccaccactttttcacttaaaaaagctgaaattcagcattaaaaataaaatttgtccaactttaacttcgcctgcataatgagacagagaagatagcctgtgatatttagtgacaaaattaatgaatattaccatcttctttttgcttcagctcacatctttatttttccctattgtttttactttttggatgacaaggcattctccagattcaaaattcaaagctcatttaaagagtatttaataaaaagaatccctctaaatcctgtccctgagccacgagctgctcctctccagaggcaaccaatattcgactttaaattcatcctgaaataccttatgcttatataagcaaatctttttctttttttatctattcatgtgactctatatttttacatgaggagctagccgttaaacccaggtctcttttcatcaaaggtccacgctttcaaactttacaacataaaccctctttcttatgaatacgctatttgtgtgtagatactgtattacaaaacaaaaatacttaggtccaaagagtgcctgtgacatgaactccactcgttgcttcagtcctgggtcgatgggatgcaaggccctgccagaacagagagtaggcagactgtacccctcccttcttagcacactgctcacaagcaggtgggcacagagtctgcaacagcagaggctgcacaactcaaggaagtgattctgcccaactcccacatgacaaccacaccaaacctcgagtaccatggctcagcagtctacaccatgaagactatggcgaagactttgaggtccttttctcacaaaagttaagagtatcattctcaactgaatgaaaagtaccatatattttctaaaccaccaacaaatgcatttgatttaccaataaataaaatattattatagtggtatttattttttcactcaagtatcaaagctactcagtgcatgagtttaaacaagttaaattttgaactacatttatgttgaattttaactcaaaacacaggaaaacaataaacaatgccagataaggttgaattaacaagccagctgatttatttttctagcttctggggccagttgctggtggctttgttcattctataggtttgcaagtatgatatacttcactaagcaggatctggtttgtatatcttttattttttctgatataacctcttctacaaaatagcaaagtaacattgggccagttccttaatggccaactttctgtggtcattcttttcagcatgtgtaatacaaggtgcttaaagtatggatttcctttataaggaagtaagaaaccccgagaaaagagagattttgtctccatcacaaaaacaaaacaatgagtgaataatttttttaaatcagtcaattcaagtggtacatattgcatgaatccaagtgtttaattaatattttcatcatcagcccaatgaccttcaaatcttttattaaaaatacctgtaaattcacagtcaaacccagaattttattacccatttcaaaattccacttctcaatataacattattatagagggaagcactagacagagattgcaaagtcagtccagaaaaacaaaggtaaaatgaaatggacttttaaaactctgcagatacagttccatctggaaagccatcacatacaactgtccaagtggaaaaaaaaaaataaaaaaggactgagcactccctactcatataagataaaagaaaattctttttctaccctaagattctgaaattgcattttgctatttccttccaatgttagaacagtgtgatccagtattggtggcatgtatgctagcagagtggaaaaaaaaaccctccaatctcacactcgggaagctgatgctgacaacatttttggcagatggactgtgattttctctcctgtgaaaccaaacattccaattaaaatggttctctgatttttgagcaatgataaaagaaaaaagaagctacatgaggagcagacagaaaagttaaacctaaaaaagagcaaaaaggaaagagagataaagacaggtgagaaatatatatcagaaataaatgtgaaagctatacaacagataatcagttggaaaaggagtaaaaggagaaatgtaggctgaagattatttaaatagaagcaatgtagtagaagcagtgatatatggcaaaagtcagtctacaatacatgaagtttatttactctggaatacacaaatttctcatttcactagctgttttaagcccagttgtttggtagtgtgtgttgaagttttcattttaggaccaaaaaaaaaaaaaaaaaacccctcttcttttattttatggatttattgtgtggttctctcagctattcaataatcatgaattaaacactttgtgtatgccattgactctgtggtagaattcgcagtacatatgtgtttgccagggaaaaagtgtgtgtgtgtgtgcatgcacacgcacacatgtgtaggcatgtaaagaatatcttaaaatcaacatatttttcttgattttctaggttaactaggagttctcagtgctctatgtgtccccttgaaacaggtattccatgccttgatggctaataactctcaagataattgaccaacttcatgggtaaatagcagggaagaagttagccagaatctgattcctcctgggagagaatgctgaattgttgtactgtagacttaattattctgggaaacacatttctaggaatccctttcctaaatgattttctttatttctagggttagagtcgatcaaaagtaaagttgggtgggactggtgagatgaagtgaagtatcagacgtcgtgttctgaaattcccattagttagtggtggtgagagacttacagggaggttttggtgggttcccgtatcttcactcttccattctccactaccagatctccttcccaattgccatcctgaccaacaatgattggtctcagatccaacaccagacacatggctgcaaactcgtagaggcagaagccacgaagcaccaaaggctttcatggacttcttcatgtgtgatttgacacaggatgaaatagaattaaagggcaactacttctttaaatactggaaggctgtgaccatggttaaggatagcacatctgcatttccatctatttgtttacaattaaaagaagaaaatagtatttttattagcagtgcaatcccctttccagtgcttacctttccctgtctctgccccttgcacactaagggaaagatatgaatgaataatttgataaactgcttgggacagggcctgaaagcctccaagtcgagcctgtgtcatgcaactggctgctaacatgtcttctggagaatggagcttcaactaattgaaggacctttgttttgtttaggggatattgtatttggaaaccattaaaatgctaagacaataggggatattgaaaataacatttttgaagaaatgcaatgaaaataaggaaggtctcttagagaaacataatggaggaacagaaatgtcgaatacagattttattaagttgtttgcagtattctatcagatatgacctctctttttttccatggaaaccggtaaaatctacatttctcactctttggtggtgtagatttactttatcaatgtgaaatttgcagtgaatacaaggatggataaacaactcttgagtgcttatccaggcactgctccagctgggaatatggtgttgaccaagatggccacatctccctgtcagtcttacaaccctgaagactatgaatggagacaacaatattaacagctcacagtgcaggcataaaacaagtgttattaaaggaaatagggaagaaaatcaagagaatgcacctagtcccacaagctcttaccagcccactgagaagtgtgcttgatcacatcaccatgaaacattccatgattgtgatcctagaaagggaactcatctctgtgcttctttacttatttacaggaaacttggaaagagtcaggaagcataaagccagcaatcaggtaactggggagatgtttggcctgtgaaacaatttgctagaaaaacaaatatccggggcttgaacctacaaacagattcactggagttaaattcagagggatatattatgatgtccaactgcacagtggacctaaccactaggtgattatgaaagtcccctatattaactatggaaatttggcttcagtactacctagacaaatggtgcttttccatgggtagaaccttgccaagatcttcacaaagccattttcacagtttcctcttgggaaacaacggtaatcctaataataacgtaaaagatctctttatgaaaaaaaggtttctgtctaataggacaggtcattctagcaaatagtaaaatctggggaaaacatacaaagaacagtaactcacctagatttgaaaagtggggatgggcacgttttacatttattctaattgtaagcaaaagttgcgggacatctggtactatggaaacagtgacagatgctagtaaagttgtgctgtgattataaattgtattttcatattgaagacctctaggtgtttacatacgctggtagagttcagtttcactgcagggatctcagaagtagggtgaggcattaagccctgaatattttaattggtctcaatatactaattggtctgaaaatgacagttatgtaaaaatctcagggtcagagatctgcattatttactggtgaaacaagttttcaattctttaactagaataaagaaatgagtatttgctgagtgacttgcttgcagaaaagttgagataaattcataaataaatctattacaaagcctgactgaaaacgaatggcttactttacacattaggacttaaaatgcagcactccatatgggaaaggcattcttaatctcttcattgttatttaatttaacatgtggagcaacaggttcattaatcacttcatattaatattcaagtgagagtgaagatgctgggacacgttctattccaaatagcgattctatttggctgggcgttgtcttaggcatgatggagagggaacaggaaggaagattaactttctgctacacttatttctgcttcattatcctggaagtcttttatgaaccattagtaatacttaaccagggtaaagccaatcttgatgtctgcccaatttaataaacaaaacctctttaatttaaagcttatgtgttggccagacacggtggttcacacctgtaatcccagcattttgacagtccgaggtgggtggatcacctgaggtagggagttcaagaccagcctgaccaacatggagaaatcccatgtctactaaaaatacaaaattagccgggcgtggtcgtgcatgcctataaacccagctactcaggaggctgaggcaggagaatcgcttgaacctggggggcggaggttgcagtgagctgagatcgcgccactgcactccagcccagtaacagagtgagactctgtctcaaaaataaataaataaataaataaataaataaataaataaacttatatgcttgtttattcaaaacagtcatatttacaaatcatgataagaaagaatgatcatttatttcatcctacattttctctcatctttggaggcatatggtagctaataagaaaagaaaagaaaagaaaaactactatttattgagatcttgagctaggcctttgctttttatttgcattgttatctaataagttaacatacatgtgaaaaaaaaatcttctcttctaatatactctctgaaaactggaatacatatagtgaaacataagaaaaggattatataacttacaatagttaggttgcctgttgaaagtttagattgttattggtgaatattaagcattatgaaatattaatggtaatgtgttgtaagctttagaaagttaatcttatttaattctcatgatggctctatgaggtaaatatttttattcctatttaatagtcaaggcagctgaggtttagagatgttaagtaatttgcccaaggtcacacaactaataagtgttagaggtgaaaaataaaatgcaatgcttgtgctcttatacatgcaaaaaattgcataagtagtctcttcagtaaatttactatgcagcatttagtagcctgtaacctaaaaaagtaagaatatgctgtgcttaaagtccaagaattttccaagacctctttggttgttcggtgaagcctggagaaccccctcaagtatatctaaggctagttaatagctcaaacaggatcatattcacataatgcaggctttatcttttgctgccttgttaagattcagtttgagcagccttccaggttaggggaggttgtcattggttcttgccttgacctgacatatagccatcgttcatttccaggatgaatttctgttctgtattaatgaacaaggtgcagaacatgaaatacaggactcattacatttcttggttttcttcaagatctttgcttacttctggcttaaatcaaatgaaattgttttcctgggtcttggtgaccctctaaaataaggagactctttgggaagctcagttggcagtctgggttgtacagaacttttagctcactcctgcctctcattttcatcacagaagatcctcaccttttgagcatcttattcaatacaatttgagttatgggaactttttaattaccctttctggaaccctttgtttgaaatcttcattttagttttcagaagataatgcaatcaaaactggacttattttattttaaatatcttcctaagtcccttctttttagtaacaccaatactagttatgctttttagcttcttctgccctctaggtagaaggtgtcatccaattatgtcgctacaagtttccttatgtctctttccttataagttaaaatctcattagattttatgaaaagtttcagtaatatgcagtgtattgcaattacgagccttggcgtctgtcttaatatgatcttgctcgaactttgaaaatacttattcatagctgtttgcctcattatgcaccaagctaaagcttgctaaaactgaaaccattttcatgcctccacgatgtcatggaaggaagtgaggatctcctagtagatttccttttttccttctaaagcagtcaagagcacagcaagatgttgctgaaggtatttaaaggaaaatgaggtcatggtgtcaccagaaaaggtcactgggctggcttccgtgagtcttcacatctgacactcagctcctcaggctcagaagctcagtcttgacaggggtaacccagatttgattagatctgaatatggagttacattacacttctcatgaaataattttcaaaacaagaatgacaagaaattaatttgcaatgaggtagataactgccagtggaatcagacactcacatcttctggtagatattctcttcttgtaacatagtaaatgaaagccaaatcatggtcaaaagttgcttagcattttaacaggtgcatcattatgatttgaatacttaagaccctcaagatagcacaacctgatgcatttatgtaaaatgtgcttgttactaagaccatataggctgaatccttgattaggcctccttctcccagggcactgcttaaacagacattgccagtactcccatgttctagtactaaccaatccattcttctgccctacaattgatttaaaaagtagaactttttgggaccattatattttaagtggtttttgttaaaaggactattgtatcttaaagtgactctgacctcatccgtaaggtgttcatttgtagttattcctcttaagagtaattttatttccccatttcaccacgttcacctccaattcagtgcatgatggtgcactggaaagagtttatcacaacaggagtcatgaggccaactccaagagacaaggaatacatatacaaggacacacacttggtacggtcagacaaataacaggatgtttcactttgtattaaattaacttgggataattcccaagatccaaggtagatctcaaaaatgaaccttctaggaaagaacaaaagcatctactggaacctggcaggaatttcagggacgcttgttctagaactcaagataaactttaaaatggaagtacaaaaacaattctttttaggaaaagaattgttaagtgaatcttaaggcatcagagcatgatgcttatgatcatgagttttagggtcaaccagagctggctctgccacgtcttaactgtgcgaatttgattagcttcaataaccggagcctgtttttctttatctgcaagactggggaaataagaatgcctacctcacaagggcaggagggttaaaaaaggcagttcatgaaaagattgaattcagtatgtgtactgcagacagcactcagtaagtgaaagttgctatttattggattaaagggttggttttattttatttaagaaggattatcaattgagggcttcagagcaacactgtactttatttacaaaataaaaatatgcaattgggaattagtttcagccattacgaactacgaaatattgtgtacatatatatacatatatatgtgtatataatgcctgtatgtatatatatattatgtttatgagcatatacgatacttaattgtgaaatgctccttaactgattgtgaagcaggtttattgcgcactgtttgttgtttattgtgcactggctcccagcttgtctgagtctggtgagacaaaacacactcatatgcaacaagttatatgaagtggattcatttcttacagataggcagcaagagacagcagatatcaaggattcattgtgaaacagtccccccaggttcagaaaactaccaagagagatggagtctcaagtccactggcaccatttatactgctgaagagggatcctgaaaggcagccaaccctaggttatataacttgtggtcacaggaatcacggggctaaagcactgtggacatcctctttttaggtgggaggactggaatggaggccagactgccccatctagttcctccctatctcagggcattgcattcccagcacattctacaattattcttgagaactacaagtgagaaaaggggaagaacagagcaggtccaaggtcacacagagaactgcctagttgcaacaaacacgtatgccacagaaatgaagcagtttaagggacggcctccagaacctgaacgcatgcttttcagtgctgtcttcttcccttactggctgtatggacttgggcaacttatgcggtctctttggacatataaaaggcttgtatttaccctctacgtttctagatttgaaccctgtaaaatgatcaccaggtaggaaaagagtcacagttatataagaacattcagaattacattctctagtaatctaaattaatcttatctctatttgatagttttctggttctctcactatacttgggcatggatctcaacaaaaaatactgcctctctgggcacatgatttttgttctttacaataagatatagcataatggctgacttcaattcattttccagctatgccttattgagtttgtgaccttggacaaacttctcaaaaccttgattttctttttagtaaaatggttataataataatgaccctttcataaggtttttgtaagaagtaaatggtgtaatgcatataaaacattgaatacatatttgacctggaggaaatattcaatgaattctattttttattttagtacagaacatacaacagtgattgtaaacagtattgagtatggaaggagaatgtgtagtgtaaaaaaaaaatcctccatttagtaataaattattttatctggggaaaaaaatcaggtatattttaagggcaatagaagctacaaaaagtagtcaggtagaaagggggaactcttggctgaaggacacatataaaaggatgcagagacattaaaaggtgaagatgtcaccctagaagtgagtgttacagaatctcaaaaaaaatattttgataatatcacaaaagaggatgagtttctgtttttactaaaaaaaatgattccaatggtcaggtaagataagatttacaaataatggaatatctttattaacccatggaactaatgcaaagttcatttttattttagataaagtgcctattttacatagatttcctcttaacagagaacgtccatcgggatcttttcatgaacagatagcttagcaagcttagctgggcctgttgtagaacttgttgattaaatgactgggaatcctaaaagggttggggtagtgtctccgcatggtcagaggtgtcagtgacatctaccctctttttcttttcttttttttttgttacttaatttaagcagcatccctctgcttttctttgtctttattaattgtcctttgaaagatggtaaatatatggcttctccagttgtggtctttggtgctccttcagagaaggctggtatttaccctctagctttcccgatttgaactacgtcaaataatgaccttgccccacccagctctttttcttttttggagaggttgtcaccatgagcccctttggaaaaaaatccatctttctctattattgggggaaagaacactgaagaaacaagactttattcccatgaaaaatttacaaagaaaatcaagaattttttaaaaaatttgaatactttctaatcaaatgtactatacacatcaggaaaaggaaaaattaaactggatctattaggttggtgcacaagtaattgcagtttttgccattaaaagtaatgatacaagtaatttgccgttacaaaaactgtaattacttgtgaaccaacctaataagagtcttagagaagatctaataaaggaagcaaaacttaacttctactttgaaagattaaaaaatgctaacccattatactttgagttcttaagatgttaggatgtgtctggatggtactaagtacttatttttatttttttaaaataatttcaacttgtgttttagattcgagggggtacatgtttaggtttggaaaactacaaagcctctttgatatggatgaggggtccccaacccccaggccatggaccagaactggtctttggcctgttgggaactgggtcacacagtaagaggtgagtggtgaacaagcgagcaaactttcatctgtatttatagccactccccatcacttgcattactgcctgagctccacttcctgtcagatcagcagcggcattagattctcataggagtgtggaccctattatgaactgtgcatgtgaaggatctaggttgtgagctccttatgagaatctaatgcctgatgatctgaggtagaactgaggcagtgatgcttgcccagaggaatggctgcaaatacagattaacattagcaaagagctttgacttcacagagaccataataaatcatttgcttgcagactgttctagttcattttcatgctgctatgaagaaatacccaagactcggtaatttataaaggaaagaggtttaattgactcacagtttcacatggctatggaggcctcaggaaacttacaatcatggtggaaggggaagcaaacacgtccttcttcacatggcaacaggagagagaagtgctcagcggagggggagaaaaacctttataaagccatcatattccaagaaaactcactcactatcacaagaacagcataggggaacacccccatgatcgaaatcacctcccacaaggtccctcccccaacacgtgggtattacaatttgaattacaattcaagatgagatgtgggtgggaacacagagccagatcatatcacagactcatatcaaaacccttttagtaggtggcaggtaacaattaagctgcccctggtggcaggctttatagtgccaagtgagttcaggtacttcaattgtatagctacatctcatggcaggctttatgtcagaatctgacatttattttagtttgcacatggcccacccattattttacttaccactttcatgtacatctcttttttccactgtgcactcatctccagcacgcttttggtaagcccacaagctaaccctagccaaaatgggtatagaacaaacatcactggagatcttccttgcaaagggagaaagaccaaataatgagagagcagaagactctaagactgccaacaaaaagaaagctgcatttaaaggaaaataccaagggtcctacataaattacacgttcattacaatagttgattcacattctccaagcccactttgtataatatgtggggactagctatccaacaaagctgtgaactctttaaaacggcttcgccacatggaaaccaagcaccctgtattaaatcacaagactttggagtttttcaaaagaaataaacatgaaaacagagaacagaagcaattatcgaaggccaccatttcatcaaatgtgtctgcactgagagcatcattcttaatggctaaccacattgctaaagtaaagaagtcctttactattggtgaagagttgatcctgcctcctggtaataatatttgttgttaacttttaggagaggctgcaggtcaaaaggtggcacatgttcctcttttggctggcaccgtaactagatgaattgatgaaatggcagaggatattgaggcacaattgctaaagaggatgaatgagccactgtagtattcaatccaggttgatgagtctacccatgttgacaacaggtaacaatgcttgtttttgtgcaatgtggcttttaggaggatgtgcgtgaggataagtcatgtgcattttgttttgccaaccaacactacagctgcacaactattcaagtctttgaataattatgtatcaggacaactgaattggtcatatcgtgtcggtgcgtgcatggatggagcagctgtcatggctgcgtggctttctggtttcactgcttgggtcaaagaggttgcttctgaatatgagtctacgcactgtgtccttcatagagaaatgctggctagccaaaaaaacgtcagcagaacttaacaacattttgcaggatgtgattttaaaattaacaaccacgttaacgtacatgcccttaactcacgtctgttcatgcagctctgtgaggagatggacacagagcaaacacatctctcagacacagaagtgagatggctttctatacgtagatccctggccagagattttgagttatgagagccacttcagaaatagcacatttcaatgacacagaatgggatacaaaacttgcttacttatgtgacatattcaacctgctcaacgaactcaatctgtcgcttcagtggagaatgaccactgtgttcaagttggcagataaagtggctgcattcaaagacaaactggaattatggggcaacaagtgaacatcaggatttctggcatgtttgaaacattagcagagattttggaagagatggagccagaggcttctttctcccagcttgtgcatgatcacctaattcagcttacaaaagaatttgagcattacttcccaaccacagaacacccccagactgggaaggaatggatccgtgatccatttgtgaataagccaagtgaatcgactttgtctgtgctagaagaggatcaactgctcgagatcacaaatgatggtggccttaaaaggtatgtttgagacaacttcaaatcctaatcatcaaggtcaaataggtgtgacaaaagcatccaaaagcctgcttccatttccaacatcctatcttggtgaagcagggttttctgcagtgacagcaaccaaaatgagattacggagtagactggacataagcaacataagcaacacatttcgggtgtcactgtctaccatcacccacagatgggaccatctagttgcaggaaaacaagctcagggctcccactgactctacattatggtgagttatatatttatttcattattatatattacaatgtaataataatagtataaagtgcacaataaatgtaatgtactagaatcatcccaaaaccatctccccaacccctggtccatggaaaaagttgtcttccatgaaaccagtccctggtgccaaaaaggttggggactgctggtatagattatattactgcctggattttacagacaaggaaattgaagcttattattgtaacttgtgtctaaagcttgtgaatagaggagcaggcttttgaacttggacattttgtatttagccacctattcctaacatctcccttatactactagagagaaggcaagtggtttctttgctgttcaggtatatgccaggttcaacagttcccaatgttacctctttatgaaacaacaatggcaaccaaaacaaaaaccttatgccacaattattctgtcatctggatgttgttgtattcttccatgctaaaagggtagctttgtgatataagttggaattttgtagcttgcctttacttgtacactcaatgaccctgaatcagaagaagtagctatcaaaggtttgagagttatctgtgccaatgatataatgcttttcttcaaggtacattcattcatcagatatgtattgaatcccataatgggaagggcattataaagttgggtgggcatagggagaaatatttgatgtagtttctactcacaaagacctcatagccatttgggacagcagaccacaaatgaataaattacaacctagcatagtgtgtgccgtaatgtaagctgctagatactttttttcttacttcaacttattgcagaactaaaaccaatatcttcattttggctctgacttggaataaatcttactctgcctcctgggacagtgaaagctctgttgagaaactaataagttcggcccaaattctcagcagtgtgcttgatgaaaaataacaaattttgagaagaagaaaagaagtaaggcagttcagcttactagaacttgatccaaatattcagagaaaaattcaggctttggttatctaaacaagcaggtggagacagttaagaaattagcataagttaaataatgaaacattcattatttcacaattgaattactaaaatccttggcataaacatacttctatgtcacatgctattttattgttgctaatagaaaacagtcatgtataatttagagagatactttaattagaatatcaattatttccaaatatataaaaataataacaaatagacaagggcatctttagagccctaaatttcagcagcactgtatgtttagtggaatgtgacactttagaatgagttttcagacattccaatatatttctgtactttggatttttatagagtggaatgccttggtcattttttagagttttgatagtatattcagtattcttgcaaactacggataaagtaaatgactgttcaaatatttgacaagcactttataaagaaaaatatgaatgatataaaatagagaatatagtataatgaaaaggcacagcaaataccttctgttatatacactcatatttctcagtctctataacgatcctctaagatattatgcaatattgggagacagatgaattgacaagagatagtgaaaacgatatttataatggcatcaccagcagagcaggaaaagccacagagcagagcagatggggaataaagttctttgttctattcggtggacttccattcacaatttttcccataatttgtaggtggacctcattcagcctgcagcttccctctaatcatgggaggcagagtagcaaattggacaagctctctgtgaattccaaaagctttggatctgaactctggccctgccttttactaacttggggattttggacaatcagtttcatccttcttttacaaaatgagaaaaatgacgtatgcataattcctatcattgttgtaaggattaaatttgatgacatatgccatgacaagatttttctccctactttaccagctactcaagccctaaaccagctgtctccaatttctcatctttgctcaatgtcctcatgtaatccacaggaaagtccaactaactctgcttccaagacaaatcttgtatctgttcatttttctccatcttccctgataccttctacaccaggaattcttaatcttggaactattgacatttggagtcatgatcagctacataattcacaagacccattgcgaaatgaaagtgtagggtatcttgttcaaaatgaaggaaaaatatgaccctaaaggtactaaagtgtcacgacttttcctttcctctgcagtctctctcttgacttgtcatcaggttaatttgctattcaaatataattctaagttttaaaaaatgttaaattactagcatgaatgttatcactcatctttatattatacaatgccagctttaaatgcaaatatatgactatttaacttgcatgcagaatcgccaaaattatacaattagtatttcatagcttgtgtatgtatatgtattttgttcttaccagaacagtagaaacactgcacaaaactaattcaactgctttcatttaacttcctgatgtgtgcatattctaaattcactctgattaagaaagaagaaaaaggaaaaggaaacaaggcttatcctatctttcttccactttccttcaatattattattttcatagtaagtagttggctaacacagagaagtaacaagtaagaaaggatacataaggttcctaagcatgtgtgtttcttcgaaagccttggcctactttctccattggaagccatttcaagcagaaaacatagatacttgaggcctccggtcctgcttactcaatcacagatgtaacatagtgacattgaactcactgtgagccttgtagaaatcccacagaccatagatccgctggaattctgtgctcattgtttatggccaacagtgaacggcggacacacacaatgcccctgtctctatggcatacaggcatgctttattgtcccaaaggatttcacttacaaatcataagttccatgataataatttttatgaaatgtcaagatgacaatagcatcacgataaatctagtgtggcatctttgagtgtgggtgggaccctgtggagtcatgaagccatgaagctgtccccgttaacatgggaaaattctttttgtggggggctcttctgcacaccatatgatgtttagaaccattcctggcctctacccactagatgctagcagcagtgaccaaaggtgaatatttaaggagagaaatgttacaactccaatgtctctttggccatttttaatactggaatagtcaaagatctggagaaagaaggctgctgggaatcagagtgccccactctctacttatgtccagatgataaattaaaatggaaatgacattaccaaaaaaaactttaataacaagaaaagaagaaataaaagcccttaagaaattaatcaataaagacttcagaataggaaacatcaagatgattttaaaatgatttagtcaaacatttgccaagtgtgaaaaaagtcactcaaacggattgattagctgaatttatttaagacagttgagctcatctcctcttagacacaatctaaagatccattatacactcatgttttttaatagattcatttatattttattgatacataataactgtacatagttatggggcacatatattctgatacatgcatacaaagtgtaataatcaaaccaggtatttagggtatctatcacctcaaacatttatcatttctttgtgttgggaaatttcaagtagtctcttctaactattttgaaatattcatgaagttattcctaataatagtctctctactgtgctatagaacactaaaacttatttcttcagtctaacagttgcacgtttatgcctattaaccacctcttcatcatccttagcccttcacacactttctagactccagtgtctaacattctactctccagctgcatgagatccatttttttagttgccatatatgagtgagaacatgagctatccatccttatgtgcctggcttacttcacttaacataatgacctccagttccatccatgttgctgcaaatgaaaggatttcattctttttttgtggctgaatggtattccattgtgtatatatgccacattttctttatccattcatctgttgatgaacacttagactgattccatatcttggctattgtaagtagtgctacaataaacatgggattgcagattatatattcatttacaagacaaaatatacttggccccctttatttgtaacatatatacctgaaattttcatgtgaaaggtatgggatttaagagaaaggtgtgtgattatcttttctaggagttagtgacagtttggcaaataagtttttcatctagactactgacttatttatatcctttggatttgaaagaagattcaaatagtagatgacttcacaggtaaattcttttttttttttcattttttttctacatttgtctccctccctacttcttctctgaaattagcatatatttattaaacactactgtcaggtagggcatgagtgcgaaatattttataagacatagtccctaccctcaaggaatttactgtctagctatgattcatgtttttgttatttcactagttttctcctcaatcatctgtcactatcatcactcctattatcatctcatgaatatcctaatttccctttagcactatattataaacctattggaccaatttatctcaactcttttaaaactttcacttagtagtctccaagaaatttcaggacttgagaataatgaaaattaatatctttaaatttgcaacgtgccttttctttcactgcaaaagcaaacagtgcacaattttcgaatgacttcaaagtgcaaatgggaaagctgcaattgtaatgaggaaaaagaaatcaaataggattcaaatattgtcaagtaagccttcatcgtggtgggggtcttggtgtctttgtggtgattgaaatacttgacagaaaattgaaagaaaaaaaacagaaaatgtgattgagaattgatttaagagggtgacaaactcaacaggacttctaagtcatcttatgtaaaatgctgtggaagacagtgaccacttcctctcactgacaggcggttccctgtgctgtcaatgagcttccctcaaggctggattaaatacactctgggaacttttgaattaggcaggagaacctgctcagtaatttagagaatttagcactaataaagactaagatgattgtacataatgggattgtaggattttagcaatcctggtttagatgacaaatgctaccacgtaaagcgttttatgacaacatatgttataagagattatacttattccctgtggagctttttcacctccattttagctactcttagaatctgtactgaataagggaaataattgaggctgtgaaatttgattcttttcaaacactatggggaaaatgttaaataaatctgcataaaagacatccacaacataaagttgagaagcttagcttacgtgttaatcattgctttgtgctgtttgcaaaacaaccaccaaatttggcccaagacaaagaatattgcctcattaacaaatttggcaacgctacagtgacagtaatcacatttttattctattttcatattcgagacttcaaagcagcttaaaaaatattcattaacaaagcaggttgcagcatgccaaccagtagctgcatcagcatagtcagatataattttgtgagctttacctaggagggcagagtttagctatagccacaggaaatatacacacacaaagaaacatgttagataagattaatgaaaatgttctcttaaaaataaatgagtttctcaatgaaaggggaaaaaatcctgcaacataatttgtcctttggattttaagtggtgtggtcaatcattaatgagaaacataatttaagaaactttacaaagactgaattgttgctaaatacaaatatataaaatggtgaggaaatatacaaaatgtgccaagtttttcaaacggattcaaaaaattatcaagtacattaaaacatttaattacaaaagtaaaaaatgcagtaatatgaatgaaacaatgagagaaatcaatttcaaaacccagtgcgatgcggatgtggtggaattgtatgcattcgtattgaaaagggtatgaaagtgagaaaatcagaaactggtgtctcaaagaagattgaggcaaagggctagactggagcaaggacacgaactagcagctgtcttaagtcagtacttgcttatctttctgatgccagtgtgactgcaagtgtgacccaggttacctaggtttgtgtactcaatcccatatgtctgaaatgaagccaatcttacctgtatattttgtgggtgatgcattcatctatacacataaacatgaagatctaggaaatgatttattttggcttccaaattaaaccagaagtgccaatgtagaggaggatcagtagcccactgtgctcttgataatgggtgatgtgcctcactcataggtctggccattggctggggcaatgggagctattggggtcccatgtggccaacatctggtagatatcttaggtttcctcagataatattcagatgccaaaaaatcatggtcctttagtacatttgttgtaactgattacattgaatccactctgagccatttgaacaccttatctaccatttacctatctatcacctatctttacctatctgtctgtctgtctgtctatctatctatctatctatctatctatctatcatatctctctgtctgtctgtctatctatctatccatctatctatcctatctatctaagtatctatctatgtatcatctatctatctatctgtctgtctgtctgtctgtctatctatctatctatctatctatctatctatctatctatctatgctatctataaactaacaggtttagttagtgaaatgaattaataagacctgaggaataattatgtgacctagactagggtcacattagattatagagatcatgaaacaagttgtttgcatcattggatatgactgtttctcaaagtttttctaatgtcacagttggtactggaaatgttctttcctcgggtgaattcaaagagacaccagagatcttaacagtccatagtgtatatgctgagagcaaataaactgagtcagtaatatacataatgatcatcaaaatccaaacattgaccagatagctcaaggtgttctaaagctataataggcatgtaacacattttctgtcctgcaacaagtatgtaagtatgtgtgtttatatgcatgtttgttttaaaaagtgtatctttttaaataaaagacttggagtcatttataagtaatgcatataatgaaataaaaataaataaataataaaatgaatgccatttgatctagcaatcccactactaggtatctacccaaaggaaaataagccattatatgaaaaagacacacacatatgcttatagaagcacaattagcatttgcaaaaatatggaaccaaattgaatgcctatcagccaacaggtggataaagaaaatatggtatatatacaccataaaacactactcagccataaaacagaatgaaataatggcatttgcagcaagttggatggagctggaggccattattctaagtgaaataactcaggaatagaaaacaaagtagtgtatattctcacttataagtgggagctaagctatggggatgtaaaggcataagaataatgtaatggactttggggactatggaagaagaagaaaggtgggaagggtgggaggggaggtgagggctaaatgactaaatatcaggtataactgggtgcagtgtacactgctcaggggacaggtgcacctaaatctctaaaatcaccgctaaagaacttatccatgtaaacagaaaacccctgtaccccaaaaacaattaaataaaaaaatatgaatgcaggcagagatatctacctcataatctaatgccaagactactggctaaatataaatacataaatttattttgtctaaaaaaaagagaatgcctaaaatataatgaagccaagactaggaaaaatatgaatgaaataaaatgctaagtaaaagaaaggagaaaaaaacaaatcttatatgaaggatgccaagcattcacaatttctatagtttactttcctgatgtctaaagctaaaagagaaaaaccagctctattgggctattcagttgtaaaatgtcaaatttcattcttacatccattctgagaaaagaaaggcaagttcttacttccaaaactgtaagtgaaagaaatgcaagcacagaaaaatcagatgccaaatacagaatcacacaattgcttattgaaagatttgggattaagaccaagcatatcagttcctggccaagtgtatgtttcctaatctcccaggttagctaggccagtagctactacgcattatctggggttagaggagactggttttgcttcccaaatggcaagtgatacagcaatggacaatgacacaagagctctgtgctcgtgtttcttatagtctgtagtcacaggatcacacatggcacccagagaacactcgggactcaacaagtgtttgttgattaattaaatacagtttgcctcctacagcattcgtgatttccagtacaaattaacagagtagaacgccgtgaaagaatatcatccttccagtaagcagctagacttttattctcattgagctaggaatgcatatgaataaacatattgttaaccattgaaacatgctcatttcagttcatttggccatgactctggctcatttttcctggcctctttcaatgtattagtaaaatcccgacttattcatttgactgaggatagcatattcctgagagttatgtgttgatggaaaataaaaaacagatgtgtatctacattactaatcctgctattaaaaagcaactgaacactgaatgatgccttaagatgtgacaaaagccaacctgatctcacctgggctcgggctgggttctgagatggcctcactcacaggtctggcattcaggtggagtgatggaagaaattggaaccctcatttcaccaacatctagaagttagtttagtgttcctcacatggcatttggatttcagaaacatcaggagtataacaagcaaaaaataaaacaaaaccaagaattttcaaacttctgtgtacagaatggttgctaatgggagaaattagaaatactggagccatttttgtctttttttgcagtcttctagaatactagtttaatttcactttttttttctaattgccttgtaaaatacaagtgagttattaaattaacttggctctttttcctgttaatgtattaaagataccttataaatcaaatgaataagaatgtaatgaggcactattatacctagcactaggtgatggcaagaaggaaaaagggcctctactgttttcattagtttatcatacatcatggtttccttgataaatcgtgagattgctgtcaatattttttgtttcttgttttctttttcttaaagagcacacatttattatcttacagttccaagtgttagaagtctaaaataggtctcactgagctaaaatcagtgtattggcgggtttgcattcctttctaaggactccaggggagaattctttttcttgcttttccagcttctagaagccccttcaattcctccaggccacttcctccatcttcaaagccagcaatggccagccaagtttttctccatcacaccaatctgactcttactcctctgtctcccccttccacgtttatgtttttttatttcaataggttttcgaggaacaggtggtgtttggttatatgaatatgttctttaatggtgatttctgagattttggtgcacctgtcaccctagcactgtctactgtacccaatgtctagccttttatcccttaccctcctcccacccttcccccaattccaaattcccaaagtctattgtatcattcttatgcctttgcatcctcatagcttagctcccacttatgagtgagaacatacaatgattggttttccattcctgagttacttcacttcaaataacggtctccaatacaagttggagagattttttatcaaagaaaaactactgctgcaaactgttctctttagacctgggtgaccattgctcatagaaaggatgaagtaacaatgttgacaagcctttgtcaaaccagagctactgctagtattggggttaaggccaggatcaacaaaacgtatattccccacaggtggctgccccttggtatttggctgttctcacactgctccaaagaaatacttgagaccgggtaatttataaggagaagaggtttaattggcttatagtcccataggctgtagaggaagcatgctgctggcatctattaggcttcttgggagccctcagaaatcttacaatcacggcagaagccaaagggggaacaatcatgtcacatggtgagaatgggggggacagagagtgtggaggcgcaggtgccgcaaacttttaaatgtccagagcccacaacccacgaggacagcgccgaggggataatgctaaaccatttataagaaacacactcccatgatcaaatcacctcccaccaggtccccccttcagtaccggggattacaattcaacatgagacttgggcagggacaaacatacaaactatatcacccttcatgcttatgctttctaactgtttaacacttaaagagcatgggaagaaacttattttctattagaaaatttttatctttattaaaatatgagagatttattacacacactcagtgtaacatggcctttgaacttaagtttgctgtcattgttcttttttcgttgttcataaactgagattgttcattactaataccctagatgattctagtcacctaaattctttatttaaaaataatggaggaggtataaaaatatgttcaggaaatatattcatgctactcagtgaagactgtagaatattacgatttagcacatggaatatagaattgacttcctagttgcaatccaagttcttccacttgctatttgtgtcaccacaagcaaattattttaacattcttaagcatcacatttctaatttgaataatagagacgataatttcaacctccaaatattgatgtaagagttttaaaatataatgtgcgaagagttcttaacataaactcaccgttcaataaggtggagctgttatcattaatgtagtttatgagactgttatttccattataaacttataggtctttagatctatgaatttaatcaaatgatcttacttttggacaaatttaaaacaacactgaggggagatgaaataacattgctggaagaatgtacacttttatttttagaactgcatttttaagaaaatatgcagaaaacataattctgaataagtagatgaatatgtctctgatgttcttttgaagtatgaactcctcttctaccttcaattttaactcttacatttcaagtaaaaaacaggtcatccaaagcatcctttatgtcagacacaacactggcagcagcaacccctattactaagctctgttagatactttatcatacaaatatttgaatctcatgttgccattgaacatctcatatttttatcgatatgatgatattttaaaaccccataatagtgcctacaagatagattcacttttaatagaatttatctatgcagcagctaatatagtgaaaagtaccgtgatctatggtatttgggggtggaaaggttgaacctttgtctagcattgattatgaaataatttgcctattaaaactatagagatttattaatctgtgttagcatctgctctttcatttttaaaatattttatttacataaattatcaaaagtctgttatggatatatttgcctctgtgtataaactctcctccctgaagagtcttgtaatagttttctcttctttcttgtgcaatgcctattctgcagtcatgtagtcgaggccttgctctggctgtactcacaggggctacctggaaaagtcattcagttgcatggaatactgagttgtgtcaataaacgctttctcaatagctttcttttctcctcctgccacctgccttcccactccaccccctagtctgacattctcaggttgcattaattctgtctcatgttctctccattagtgtgaattatttgttatattttgctttaattgccatccactgtagtcttttttaactctctccatctaattttgtccattccaccttcattatttctactcttttcccaaatctctcccaaggcacagattccccaggctctcccttattttgctagaacatttagtatgtttcctttaatttttaaatcccagtaatgactgatgcttccaaacactttggatattgggattttaggttaaagatgattcatggtatgaattacaaagaaatgatttagttcaaagtgactggattagtgatttagaggagactaaaatttaagattacttaaggtaggctcgggagaaaaaaatacaaaactaatcataaaattttgcctaaggattatgtcctctttgaatatgttccttattcccaaaacatcctttggctgtaaatatagataattcagttttatagttttacaactattcagttaatttacaactccttaaaagtgaggttagtgtcttacactcactgagaaacatccccaaagtcttgggatttcatcttctgtctttcaagatttatttcattatgaagcaggttgctcaccttccaaaagtggaaatccttcatctgtaaaacagtgttaatgatgtatacttcagagtcttagtatctagggatcacagcagcaaaatcaggaactaccataattgctactagcatttggagaaaaatattccacagtgtattagaaagcagaggtgttggtgttagtgaaaggtgggtttgagtatcagctcatgggacatactaatggcctgatcttacatttgtcacttataccatatgactctgttctctcatctagaaaatgagtatcatgggttaggcgaggtggctcacgcctgttattcccgcactttgggaggctgaggcgggtggatcacgaggtcaggagatcgagaccatcctggctaacacagtgaaaccccgaccgtctctactaaaaatacaaaaaattagctgggcgtggtggtgggcgcctgtagtcccagctactggggaggctgaggcaggagaatggtgtgaacctgggaggtggagcttgcagtgagccgaggtcgtgctgctgcactccagcctgggcgacagagcgagcctccgtctcaaaaaaaaaaaaaaaaaagaaaagaaaaagaaaatgagtatcataatagcgctgtattagaagacaccaatgcctgtgctcagcagagcagtggcatccacattctctttttgtgcatagttttccagcacagagtagaacgcaccaaatgtgttgattaactgattcctataactttgaatatatcattaaggaacacaaactaagtaggtcagaagactatagtagataaaagaagaagaaggtacaattaatagtgatattgacacaaaatgacagttctcaaaaaaaagttcacgaatctgtataatgatcaagattaaagaaaattttactttgaaaactaagtttggtaattatatttagcggcaaaaaaaatgatgatcaaaacacttccagttaacacaaagaatttaaagttgtgattagcttgtagatagaacttgaatttcattttgagaatgattgaagtttgggttaaagatggaactcaaagaacagcaatctgcccacttaaaaagttactgtttccttttttcatattaaagtgttttattctgtaatgacgtactgagagacagaaactcacccagcttgggttaaaaatcatacaggatccccatgtttctcttttcggttcctctttacaatgggcattccactatgagatagcacagataacttggctgagaactcttcatttacacacaagatgcacagcctggaggtatctcatagcccttgtcatggactgaattgtgcccctcccaaattcgtgtgttgaaatcttaaccctcaatacttcagaatgtggctgtatttgaagatctggtctttaaagagataaaatgaaggcattagagtgggctctaatccaatatgactggtgtctttacgagaaggcattaggatgcagacacaaaggggagatcatgtgaaaacactagagaaggatggtcatctacaagccaaggagagaggctgcagaagagctacatccctgacaacaacctgctctaggacttctagcctccagaactgtgagcaaataaatttctgttgttcaagacttgcagtcatggtatttgttatgacagccttagcaaaataagacatccgtgttcacactgtctccagcactggatgtaggaaaatctcttttattatcttattccaaaatttgctcaatatctgaaaggtaatcttcagattcagatctgtgtgactctaaacaaattttgaaattttatacatattgaaattttatacattatatatgtataaaatatatacatatatatattgctaatggtaaaactattacatgaacctagcaaaattatcacttgggcttaccattgtcatttttactactaataatgtaacttttagggttgaatgtaccaacaacacttttaaacattctatataatattgcaagcagttaattttgttgggtagtttcataaggctattttttatcctcctataaaatatttgagtttttaagggaagccccccaaaattgctgtatcagaaaaaaaatggttttgtaattgtgcctctaactctaaaatggaatattaaaaatgatggataaaattttcacaatagtactttaagacatctagaaatttgacagatgattgtcacgattcaatccctttttcttcatgttttgcagtataaagcaatattttaattgagaagcatttgacaaaacagaaatacatgctgtatacctctttatgcatctgttgagatgttcttaaagtcagcattgatttgcaaaggccaagtgccccacagcccactggagaagactagatacaattccacaaatgcttactactgtgtcgaaatttgtagcagttgctctgattttaggtatggatatgcagatgaataagtcatgtctcctttcgtcacagattttacagtctggtggagagacaaacatgtttaatgttatttagcacagtatgtgctatgagagacacctgtatatatcccagggtttatcaccaagtgaaaataagtgatctcaggttgactgataccttagcacagagtaaaatgaatttgaggcaggagcacgttttctaaatgtttttgtgtgctacaaggcaaagagaaaacatactgctcaagaaataggagatagttggggaaaaggcaatttatacatgaaaggtatgagaagcaattctgaaaggaagatagagataagaaataaggcataaaactaccacccactaatcgcctttccccaaaaaaatgaataagcaaaggtcaagatcaggggctttgaaaagagaaatgcttgaactagaacatacacaataggtaaaacatatttgcattggatccacaaatgcagaacaacccccgatatccccaagccaacttttcaaatttttataaaaatagactagaattaggccaatttaaatcatcacttatttgttgttgcagccaacatttggatagttattagcatcattcattcctgaagcatgtattgaatgcctactatgttccacacaattcaataacaaataaaatcaagcttagagccaagtgaggctctaataacttcgaaatggcgatatcttcatctatcctatttattgagaattgtctatgtttagagcacggtagcagggtacaatatagccaaatgctgtcgctctacataggaaaacacaccgagttttatctgctactggttttcagctgccagcagttctggaaaatttgagaattgtctatgtttagagcacggtagcagggtacaatatagccaaatgctgttgctccacataggaaaacacaccgagttttatctgctactggttttcagctgccagcagttctggaaaattgcatcctaatgacagatgctactatttaaaatgaaaactgattttttttttttggtaaaagagactgagagaaaaacaagttttagacaaattccaaagcatgaaagaatgctcatcccaaccatttctgtgggaagaatatctagaatgtggttggcagccaaatagccatataactgtgtaattgcaagctgagtagagaaagagactagcgtcaagtgggagatattccagggacaagtagaaattcaagggaaaaacgcaccgtggggtcacagaataagtcttttcacaaatcctgtgacaaatgctgtttgccacatgtacttaatatctaattggaaagataattctggctgtctttagctctcagggctcttaggagtttgatgtgacatacaggtgttaaagtacgtaaaaaatgttaaacaccagataaatggaaaggtttgtgattaaaaattaagtttcaccgcattgagaaatgccacaagtaggcagacttgcagaagtattgtcttcaaagatgtggaatgagctatgtggaatgaaccaagaataaaacattcctcataattgtgcccatgcttaaagccattgccaccagcagtaactttatcaaaagagggcataatcagtcagaagcaaacaatttcaaatcactgcaaatatcatgtgacccatctgaagagccattttgccacacttttaaatgtgtttttctcctgatggatgattaaataggcagttaatgtcctttttccttgagtgattgaaggacactaagtcaaaattacaatttagacaagacaaggaattctgcactgatgttctaatagcacacgatatttgaaatgatgatttatactccagtccttcttgacaggatgtgcctcatgctgaggatgtctgtctgtctgtctgtctgtctgcctgattcattggcacatgtctttttgtctggacttagtactggttctccatgaagtaggaccctttacaactagaaaacttacccttacccccaccatgtctctgggctgaaaactaatagtcccaccaaaactgtggccagagttgttggaagactcttcctataattaatgtcctataaacttaattctcttcaacaaacattcattagatactaactctctttgttaagtactatagactacacaccacacaaggataaacctccagaaatttatcagctgctaagagagataaaccatgtacatcagtgtggtaagatattttgtattaaccatctgcctctgctacccctcctcctgggtcctcacacccactctgtgtacccagttagatttcatatgccaatttccttggagaagcactccatggagaactgagaaacaacaaaatgaaatgctttgctcttaagttctaatgatgaaatccatggagatcttgatccaaataaataaataaataatctatgatccagcttgttatctcccaactgaaactacacaaaggatctacagagcaggtgaaagaatgaggcagtggtccacattaactaaaatgagcttgataaggacagaccgctgagccccgcttggcaggcgcgtcagtaaccagcatcagggagtcagtggaactgttcttctcctacggaacctcaggtcttcgtgcagataagccctgtacattgcctgtgaaaagaagttctatcagctttccttctctttgtcatttgatgaggctttttaatcactttaaactcccagctcccatcaccgtatcttttttatgtggacaagcctctttccaaaaacccaggacacaggatggagtcctggaccccccaaaaaatggcagtgatgggaagggaaaagtcccacaaccaagaaagatgggatttagcagaagcaactgaaaatcttccactagttgaggcagtgctaaaaccaatgctcatttgacacaaatgttttcttaggcgtattccatggaccaccaatatactgtaaggtgaaagtgtctttattattaaaaattcataattccatagttaagcaagctctcaaatgttttatattctaaatccttccataaatgtctcaagactccaagaaacatatagtaggggaaaattacaatttcccaaatttaaacgatcacaaaattctttgtcaagaaacatcaatcttacagtacactaatgttccatggacaacagtcttgaataaatattatttaccatgaaatatattgcgtatctattatgagttaaatactaatctaaaagaataaactagaaagcagtgttaaccttaccagagacgcagattaaatgttgcagagattcaaaggaaagaaacctcattcctagccaagacgtataggcggtgatttcaggaacatggcatttaggtatggtcttgaaaatcaggcagcttttgaatattggggggtggatgggggaaagttatgctgtgatgagaaaatagcagaacaggtataccaaggggaagagaaccagcatgaagaagagaaagtagcttttcttggctgtagaataggaaacccaaacagattaacagatatgacaaggcagaagaggctgattggggccaaatatggggagcagtgatttcaaaacaaagtttgatctttacttcatagaaataaccatgacctgctccaggttaataagcaaaataatcacacttctaaggcatgactttcacatcatccaattaacatattcatgatgcacatattatcatattgcattcatgagtaacgtagagttaaccctccagttaaaactgtgagacagaaaaaacatattttttgtcactaccctttttttctgctctgtgcaacttcgctagaattaactgtggtcctatcttctgagtacatactaattagacttcctgccacctaagaatctttgctatcctcatttttcttcctcatggatatttttcatttttcctcacctctctctgctattatctatgcacctctccacttttcaattattctacatatttaacaagttcccaagagagaagagtgtccaactggtgcattttatttgacaatagctggtatttatgtaatgagtgctgctatgtggcaagtttttcttgcatacatttatttttaagaaacacacattaataattcccctgtgcaagagatgaaggtaagaggtaatagtaatttacacaatacaaaccagaagttccaatttatgcctgtcagactacaaggtgcattcgtaactctggtaacaatttatttctgggccttcagagacaaggttgcttaccttcctaagtaactctaattaaaacaacaacaacaaagttttaaggaggttgaggatgaaaatttggccttagaaaaaacaaaggattatctaaggtttgcctattccgttcattcaataggccactctgcttaaaaatttaagaattcgctaaacctcagtccactctgttaacaatattcattggaatattaaatgtttatttatttatttatttttgtctaaaggatatttgggaagtatactgtatcaaagcagcagaaaaggagctgtaatagttacttttcagtgtaatactaagcagttaatttttttaaagaatgatttcgcggatttttaaataacctgattttataaggtaagcaaaacctacttaataaatgaaccaagtctaaaatctacctataacttaccagcagaaaacttaaaaataactacattattatatttcaaagtattcttaaaaacttgaattagcctctgtaaaactgtaaaaatacaaaataattgattaaggaataatatataaaagatgggaaaggacatagcttatgagaagaaaaaattaaatagagaaaaggaaatagtgtgatactaattcagttgagtaaaaattcagttattcattgtttttcttaccagaaatatgacagttaggcaaactacttaaactctgtgttttagctttctcatctacaaaaagagatatgaatagttcctacttcctatatagttgttgagaagttacaagtagttcataattgtcaagggtagaggaagtgttcaggatgtagtatgagccatttaagtattgactactattgttactaaagggactgaaaatgacaactatgagtattttgcattttgcttgaaaaataaaacgacgtgtggatacaaaagtattaaatatttgcaaaattcacaatctatgaagaattacacaaatgtggatgacaatggtcgaagaattgaagcactatggtgatcattagagactcaccaaaccccttccttctccttgggcacacagtaggatttcatttctcagccttatattgcaactaggtgagtccacgtgacttgagtgttgtccattggaacatgcacaagaggtatgtgggtcacttccaaatgtaaaatgtcaaaatctcccacagtatccttggtgtgttctcactcctcatatcctgggcagatgccaaaggagatttcactggcattgggagatctcagagacagagagagcctgtgtgctctaatgatggtgcagtgaacagcctccacttcccaacttgccatctcacattttgatcacgtcatgaacattttttgttttaagccactttggtttcgaacttatttttcacaggaattagcctactataactgacagagtaacgaaaaagtattcaaacaggaattgggacacttgtgtccaaattgcctttctcacgtttactaactatgtaaccccagggatttactcaatctctgaattttcttttctttgctgtaaaactcctattataaaagttgtaggtcttcaatccatcttgaattaatttttgtataaggtgtaaggaagggatccagtttcagctttctacatatggctagtcagttttcccagcaccatttattaaatagggaatcctttccccattgcttttttttctcaggtttgtcaaagatcagatagttgtagatatgcagcattatttctgagggctctgttctgttccattgatctatatctctgttttggtaacagtaccatgctgttttggttactgtagccttgtagtatagtttgaagtcaggtagcgtgatgcctccggctttgttcttttggcttaggattgacttggcgatgcgggctcttttttggttccatatgaactttaaagtagttttttccaattctgtgaagaaagtcattggtagctttatggggatggcattgaatctataaattacattgggaagtatggccattttcatgatattgattcttctgacccacgagcatggaatgttcttccatttttttcgtatcctcttttatttccttgagcagtgttttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagtttaaggagattttgggctgagatgatggggttttctagatatacaatcatgtcatctgcaaacagggacaatttgacttccttttttcctaattgaataccctttatttccttctccttactaactgccctggccagaacttccaacactatgttgaataggagtggtgagagagggcatccctgtcttgtgccagttttcaaagagaatgcttccagtttttgcccattcagtatgatattggctgtgggtttgtcatagatagctcttattattttgagatacgtcccatcaatacctaatttactgagagtttttagcatgaagcgttgttgaattttgtcaaaagccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctgaattcggtttgccagtattttattgaggatttttgcatcaatgttcatcaaggatattggtctaaaattcaattttttggttgtgtctctgcccagctttggtatcaggatgatgctggcctcataaaatgagttagggaggattccctctttttctatttattggaatagtttcagaaagaatggtaccagttcctccttgtacctctggtagaattcggctgtgaatccatctggtcctggacgttagactaaaaccataaaaaccctagaagaaaacctaggcattaccattcaggacataggcatgggcaaggacttcatgtctaaagcaccaaaagcaatggcaacaaaagccaaaattgacaaatgtgatctaattaaactaaagagcttctccacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgacaaaatgctcaccatcactggccattagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccgttactgggtgtatacccaaaggactctaaatcatgctgctataaagacacatgcacacgtatgtttattgaggcactattcacaatagcaaagagttggaaccaacccaaatgtccaacaatgatagactggattaagaaaatgtggcacatattcaccatggaatactatgcagccataagaaatgatgagttcatgtcctttgtagggacatggatgaaattggaaatcatcattctcagcaaactatcgcaaggacaaaaaaccaaacactgcatattctcactcgtagatgggaattgaacaatgagaacacatggacacaggaaggggaatatcacactctggggactgttgtggggtgggggatggggggagggatagctttaggagatatacctaatgctaaatgatgagttaatgggtgcagcacaccaacatggcacatgtatacatatgtaactaacctgcacattgtgcacatgtaccctaaaacttaaagtataataataacaaaataaaaaaaaaaataaaggtggtaggaaataaatagtatagtttcagggcttggaatggagtgtaaatattgtaatggacagttaaatctaaatgtagcagtaatttagtcaatacttacatagcactgaaatgtctatattgggtaggacaattagtaaaatcatattttaacaataataacaactatttagttgcctgaatatttcacttttcaatagctgatttcacaagaatgcagctctcaaagatatcgtgttgcttttaaccattttctccagatacatggtatcaatatattcaagaaaagaacagggttttatttttttcctgatgtctttgcaccaattttcccaatttcttttctaatagagtagcttgtatttaatatgcacaacaactgcaggtcattaattctctgagtctttcctaaatcaatcctctggatgtggactagaatcttaatacagttttagtagttgggaatctcatctaatttattacatggagagaggtatgacacaggaaaaatgcatattaactatgtagatgaatatgttttttttttctttccaagtatctgttttcttttcaaaatgatcatgaatagatagctacctaaggaaggttgtcacattagcttaatcaatatagaaattctatatatgaatatatatataagaatatagtattatgcatgcatgtattttacagctagttgtctattttctagaggcagctagacagtggtgaagagcaagtttcagctttgaggttttttttaactttttattgggaaataaaatagacaaccacgaaaaaaatgcattaaacattgatgtaaaaattaacagttggatactaaataaactgttgtacaactatcacatataactagaaatttaacaacagtaccagcacctcagaagccctccatgtgccccttctcaattaaaattcctccctctacccgatgaaaccactcttttaacttttgtcgtaatgaatttcttgctttcattatacttttaccacctaactatgcatccttaaacactatagtttaattttcatgggtttttgaagcttatgtaatgaaatcatcagttttattcttttctaattttttctttaacttaaaaatacttcataagatttattcgtgttagggccaggcgcggtggctcacgcctgtaatcccagcactttgggaggccgaggtgggcagatcacgaggtcaggagatcgagaccatcctggctaacatggtgaaaccccgtctctactaaaaatacaaaaaaaaattagccgggcttggtggcgggtgcctgtggtcccagctactcgggaggctgaggcaggagaatggcgtgaacccgggaggtggagctggcagtgagccaagatcgcaccactgcactccagcctgggtgacagagcgagactccgtctcaaaaaaacaaacaaacaaaaaagatttattcgtgttaatttatgtagctgtagtttgtgcattttcaatgctgtataacaattgtttgaagatgccacaatttttatatctgttttactgttgatggacatttgggttatttccaatttgggactattacaattgtgatgccattaacatttttgtgatagtcaataacaacgtacacttaaatttttgtcaagagggtaggacttcacattgggttcttaccaaaacaaggtaaaatagtaaaacagaataataattcttgtacgtgtctcctggtggtcttagtggtcatgtgcacatctgctattggatgttgccttagaggtagaattgttggcttagaagtatacaatttatattcctaccaacagattatgagtaaaccagtggctccccttccttaccaatgcatgagcattctggtgagtatattatactattgtagctttaactgtcatttgattgattgctaaggaaattgaacacatatttatgtttctcagaaatttggattttctcatttgtgaagcagctttgaagtctttgctcttttttgactgggttgtttgtcttctacaattgctatgtacattctgcatatagtgttttgttcatttacgtgttgcaaatattttttctttcattctttagcttatcccttcatcctcttcatgtttcattttcatttgacaaacagaagtccctaattttaatataattttccaacttcttctagtatggttattaccttttgagatgtgtttaagacatatttttcaaatgtgaaggttaaaagttccccaaaatactatctatgtaatcttctttaaactttgcagctaaatagctttaaaatttagctgtatgaggtattttcaaaaagttcatggaaaatgcatattatgaaaaaaactatgcatgtatttcaaaagtttttgcaccaaaataaactcagactaacttattaaaacatgcctaaacaggatctagtttgaggcactaaaaaggataaggtataagttataaaagagcatctatcagaaaaacatgaattgtgctaacattgaagcaagaacaaacatcaaatttataattaatggtgaaagaatggtgaaatcagtgatggtttacaaaaagtctatggaaaaaatgccccaaataagtcagcagttcacaaatggataactcgttttgtttttttgtttgtttgtttgttttttgtttttgatacggagcctggctctatcacccaggctggaatgcagtggcatgaactctgctcactgcaagctccacctcctgggttcatgccattctcctgtctcagcctcccgagcagatgggactacaggcacctgccaccacacctggctaatttttgtatttttaatagagatggggtttcaccttgttagccaggatggtctcgatctcctgacctcgtgatctgcccgccttggcctcccaaagtgctgggattacgggagtgagccaccgcgcccggccacaaatggataactcattttaagaagggatgagatgctgttgaagatgaagctcatagttccaggtcattcacatcaatttgtgaggataaactttattttgttcatgtcctaattgaagaggactgaagattaacagcagaaacaatagctgacatcacagacatctcaattggcttagcttacacattcctgactaaagaattaaaattgaatgtgcaaaacgtttgtgcccagatcagccacagaccagggcagagctttcagtgaaaattttaaagaagtgggatcaagaaccttaagctctttcttcaaataataataatggtagataaacatggctttaccagtactgtcctgaagacaaagcacaatcaaagtaacagctaccaataagtggtgtggtccagtcaaagcacaagcagaccagtcaagagcaaagattatggcaacagctttttgggatgctcaaggcattttgcttgttgactttctgaagacccagagaatgacaacatctgcttatcatgagagttctttgagaaagtcagtcaaaacttaatcagaaaagtgcccaggaaagtttcactggcaagtccttctgcaccatgaaatgtttctgttcattcctctcatcaaacaagggccattttctgagactttttgatggaaaaatcatttatcatccaccttatggtctatatttggctcttcctgattcctttttgtttcctatgctattgaagttgttgatttatttaagtaatgtgatcaatatcaaatttcatttttttcaaatggatgtctaattcttcccacatcatttattgaagaactgtctctttgctactgtgcttcaatgctacctgtgtcataaatcaagcatttaaaaatgcaacagtctatttctggactctgtgatcgttcagttgtctgttttccaatcctggtactaatatcacattttcttgattgctattgctttaaaataagccttgatgtcaagttaagaaactcctctcatgttcttttttcaaaggaatcgtggctattattgacctgttatttttatgtgcattttagaaccagctcgttaagttctactgcatccccaaataaaaagcaagctggtatttttaaaatagactttattttttagtgcaactttgtgtttacagcaaaattaagaaagtacagagacttccctgatactacgagctcgcacacatatataaccctccccattataaacactccccaccagagtggcacatttgttacaactggtaaacttacattgacataccattactaccccaaatatattgtttaattaagtttcactcttggtggttgtacattctatggatttggacaaatgtgtaatgacatgcatctatcattatagttttaaacagaatattttcactggcctaaaaatcatctgtgttccacgagttatccctccctcctccctcattcccagaaaccactaatctttttattatctctatagttttgcctttgccagaatgttatatatttggagtcatacaatatgtagactttttattggcttctttcatgtagtaatatacatttacattttcttcatgcctttttatggcttaggagctcatttctttttagtcatgaataatattctattgtctgatgtaccacagttgatttatccatttacctactgaagggcatcttggttgcttccaagttttggtaattatgaataaagctgctataaacatttctgtgcaggtttttgtgtgaacaaacctgtgagttaataccaaggcattcaatgaataatatggtaaatgtatgtataagccttggaaaaaattaccaaactgttttccaaagttgtactattttgcattcccaccagtaatgaataagagagctcgtgttgctctaaatccttgtcagcatttgatgttgtcagtgttttgaattttggtcattctaatagatgtgtagtggtatatcattgtttcaatttgagttttcctgatgagatatgatggggagaagagattctttgtcctcaatatctcttctttgatacagtgtcttttggtattttcaattagactgcattatatctcaagatgaatttggggagaattgtgacctttgtctccacaaaattatatgttgaagccctaaccatcattgtgactgtatttggagatggtgtctttgggaggttattaaaacaaactgtgatcataaaggtggtgccataaccagataggatttgtagccttataaggggagaaagagtgtatctctccatgcacatacatcaaggaaaagctgtgttagaacacaagaaagtggctgtctgtaggccaaaagaagaagtctcagaatgaaatctgccttacaggcatcttgattttgaattttccacctttaagagcaggaagaataaatttgtgttgtttaagctacccagtatataatattttgttatcaccatctgagatgacaaatagattttggtaccaggagtgaaatactgctacaacaaatacctaaaaaggtggaagtgactcaggagctgggtaatgggtagagactgaagaagttttgagatgtatgccaaaaaaatatggacattaagagtggtttcagttagacattagaaagaaaagaggagagctggagagaaaacttccatctttttagagactatatagccatgaaaagaatttgataaaaatatgaatgttaaaggccactcttgtgagatgtcaaatgaaaatgaggaacatagtattggaaatgacaaaaagtgagacttgttataaaatcgcaaagaacttggctgaagtgtgtttgtgttctagtgtttggtagaaggtagaactggcaaggattgaaatcaaatacttagcttaggaaatttctaggcaaagtgtcaaaagagcagctttgtttttcctgactgcttatagtaaaaagcaagaagagagagatgaattgaggaagacattattaaacaaaaaggaactggaacttgaagatttggaaattctcagccaattcatattgcaaatgttgatgataaagtatgtactgaggacaacaccaatggtgtgactggactatcacttgataaaatgtatgtaagattatactaacagaaatacagcaagtatgaactgaagggaacaaagataagatgaaatgaatgaaggccatcagactcattaaatttcacaggatgagtagatagaacaatttggctgcaaatgtattctatcctttaaaaagagagagaaatggccccaagataatttagagattttcagggccactaccttggttgcaacaagctagatagttgggggcagaactcgctagcagagccttggcagcaggttcttagggatgaggttttagaggcaggagcttagggatgagaccctaagaacaggatcaactggcagattttatagagccatcaaagccaagggtttctatttctagatattttttatttcagtcttttcacatatgatatttacatggtaaaattttatttactgtttattgctggaattagatataaattgtgtttgctgacttttgccagcaaccatgtcaaaactcttattaattctaataatttctttatattttatcattgcattttaatacacactttagtattatcttgccaatttctgctaaaaactacctgagattttgtaggattgtgttgagtagacaaatttgggtggggggagtgggtattacatttttaacaataataaatatcttgatctgttagtataagttgcttttctatttacttagatctttaatttctttaaataatgtttccatttatggtgagacatcttcacttctttggattaatttattcctaagtattttattcttttgatgctgtcttaaattgaattatttacatttttagtttattttattgtatttttaacttttattttaaattcggattacagatgcaggtttgttatctgggtaaacttgtgtcatgggggtttgttatacagattatttcatcacccaggtttttagcctagtaccctttagtcaatttttctgatcctctcccttctcccaccctgcaccctccaaaaacaaatatcatttaacctagcaatcccattactgggtaggtacccaaaggaatataaatcattctatttttttattttttgtagaaacagggtctcattatattgcccagactggtcttgaactcctggcctcaagtgacctgctggcctcaatctcccaaagtgttgggattacaggcttgagccaccaggctcagcctgtatatagattatataattgatttttgtgtattgatagttacatcctgcaacattgttgagcttttttattagttataataactttcattttatttcttaggatattctgtatatataaaatcatgttaactacacataggataatttacttctttcttttgtatctgaatgtcttttattttattttcttgcctaattgtcctggttagattgtttagtacaatgttgaatagaagtcgtgaacctgggccgggcacgggggctcacacctgtaatcccagcactttgggaggccaaagtgagtgattgcttgaggccaggagttagagaccagcctggccaaaatagtgaaaacccatctccactaaaaatatatacaaaaaaattattccagtgtggtggtgcgtgcctgtagtcccagctactagggaggctgaggcatgagaatcgctcaaacctgggaggtggaggttgcagttagcggagatcgcaccacttcactccagcctgggcgacagagtgagttctatctcaaaaaaaaaaaaaaagaaaaattagtgaacctggacatacattcttgtattgttcctcatcttatcaggataatgtatagtccttcaccatttttaacgtgatgttagtttacatttttcacagacaccttttattagtttgagtaagttcactagttttccgtgttcattaactgtcataaaaagaagtttgtatttttctaatggtttttctgtagctattgagatgaccatgaggttattgttctttaacctattaatataatacattatattaattgattttcagctgttgaaccaaccttgcatcctcaggataaattcccacttggtcatattatataatcctatttatgtgttgctggctttgttgtcctagtattttgttaggttctctatttgtatgaaaaagagatatttatctgtagctttcttatggtgcttttgtgttgtttggtgtcaaggcctcatagaaggaggttggatatatttcctcattttctatgttttgaaaatttgcgagagagaggtgttatgcttcaaattttctctagaatttactaatgaagccatttgggcatttatttgtgggaagttttaagatttttaatgtattccctatgatttgtttcaatccattcagatattttaatttttcttgaatcagtcttggtagtttgtttctagaaattattccctttcatataagttatcctaattttgacttacagttttttatagtattcactttcatatttaaaaaaaaatatttctgtaaggtcagtagtaattttagcaatgtaagtcttctttattttttttcttggtcggtgtagatagtgtttttaatttattcatcttttcagagaaccaaattagattttcttgactttctctattgtttttcttttccattaatttctgttctaacttttattattcccttctttatacttgctttgtattaaattgtttctctttttcctgtctcttagcaagaaaaataacgctatttagttgggatctttctcttttttaaatatagaatttacagctatatatttatcttaaagcgctgcttttgctgcatctcatagaatttagtatgttgtgtctttatttgcatttatcttaaactattttctaacttcctatctgtgagcattggttacttagaagtattcattattacttttaaatattcctgcatattcttaaatgtccaaaatttccttcttattgatttccaatttagttttattatggctggaaaacatgtatgatctcaattttataagaattttttcaggcttgttttatgacagcacatatgttctattctgcagaatgttccatgtgcacttgagaggaaagtgcattttgctttaatggcttcggtgttcagtacgtatctgctatgtctagttggcttatagtgttgttcaaacatgtattttcaaattcttatatttccttgctgatcttctgtctagttgttctacttattattggaaattgagtattaaagtttccaactactattgttgaagtgtctctctcttttattttgtcagtttttttaaatataattttggcttctgatattagtgcatatatgtttgtaattgttacaccttcctgatgtattgagtcttttatcactataaactattgctttgtatctctggtaatatttattttttgttttaaagatgatttcatctgaagttaatgtaggcactctagctctctcagggttgctatttgtattgtatgacttttgaaatatttgtactcaagctagttgtatctttgaatctaaagcatatctcccttccaaagtgtataattgttttgatggttcttatctagtctaatgatctttcactcttgattggattattcaatccattcacatttaatgttattattgatactgttggatttgcatctgctagttttcttttggtattgtatgtctcacgtctctttttgtttctctgttcccccatactattttttcatttaataaacatttcctggtattaattttaactatatcttttagttacttgcttagtggatgcactagggtttataatatataccttaccttatgagaattagcatcagacttatactatcttaattccagtgagctggatgagttttaatcttataaagctctattccttctttcttctttttgtgctactattgaatattttatcatcaattatgatgttttctcttaagcttttttaggaggcaagatggacaaacatttcaataaatcactatttcttaaaaatctggaatgaatattaaattttaccagatgctttttctacatttattgaaataattatataatttattctttattcagttaatgtgatgaattatcttgcttgattattttttctgtatcaactttgcatttctggaataagtacatattgatcctgataatattattattttaaaatattgttggcattagtcaattaatattttactgagaaatttttatctatatttgtgagtttggctagatgattcttgtcatattttagtactgagtttactacattgtcaagttgaagttaattaattttttataatttcttaaagttttttttcttaagtttgaaagaaatcactactaggaatatatttattccatctaagttttcaaatatgaatttcaaaattttggaatttgaaatttcttctcaataaactatattatcgttaggcagacatgagtatgaatctggtttcacccacctatcagctatgagaacttagaaaattcagttgatttctctgatcttcagttttctaatgattaacacatggataattaatagtacctattgcatttctgatagcaaattttctatatggactactcctgatggtacaaattatttaaaattcaagataaaatgtataaataattctttagctggaagagaaagcagaaaaatcctcaaacagtataaaacatcagtacagagctaactttggccttgaggcatctgtgaatctccagtagcttacaaattaggcttacaaaacctaaagccaagtaggataagactccacaaaaatccagattccctaaaatgcattactcttgatagaatcttgggaaaaatcttgccattcagtaggaatgtgtggagatgtatagcgttcttagtctagatcctgagtaaagtagaaaaaaactagtgctctccaagaagtcttagctacaagtcagaagtcaatgagttgggactagaattcacaagatttttgtgccttagaaaaaagaaaacaactgaagtcaatttctgtttaaagttgttctgagttggcagtgtacccaggtatctggaaagaacaaacacaaatcttctttataggaagcactttcagtctgacctgaatgtgtttacagagaaagtttaaaaggatataaatatatgcacacagcaggaaacatctaaaaaaataagccgctataagcaaaagtcagcagacgtaatgaactacagactcagtctgtaggttctgcatatactaggtcctagaatcatccaatactgaattacatatctatgtatctatatctatatataaacatgtgtgtgtatatatatatatttatatatagctgtagatagaattaagactttatgaagaatagagaactactgtagtataattttggtaggctttaggcacttaggccttcctgcataaataaataaataagataaataaatgtatacacacacatataatttatattttatgactgtgctggtataagcacaaatatattaatattacatatcaaaacattttcttcaatccaaaggttattttatttcttctagttttataataattaaaacattttaaggaaatgtgccaggagccctaggcattgtacctaatggataatttggcccttggaggaagcaataagatggtattgacagccagatttagaaagtaaccaaatagaatttttagactttaaaagatttaattataaaaattataattttaatagtggcctaataacaaattcgacacagctgaagaatgaattgttataataaactgagagattttaaaacacgttttctcatttctaatctaataatatttttactacattctgatttctatttactaagcagtttgtggtcattggccttattttgtgcctagaactgtgttatgtgggattagggtataaaacagaaaagctattcacatatgtaattcctgtgatttgaaaattcccaaaagttttgtgcataagaaatctggagcaacgatctttaaaatagactccacatatctatcctttaaaataaaatagttcatgctcaaaaaaatccagcactatttggaatatagggtttaaattttgatacatttttttcaattttgttttgagctttattttctaaaatgatctaaagaatcatttcctttgacttcttcccactatgcagggaagtaagactttgaagaagtatatggcttattcttgttctttaacattcaaatgtggctcttatccccactatatctaaacactttttatttttatatgtacacctcattaagtagatagtaagtactcttaaatgaagcaagacaccagtgcagtctctttattccttcacgtgactaatatggtcttgccacatggtatatgtgaaatcaatacacttctcaatgcttcttgtttatagaaaatcctcactttgattttattgtttgattcttttatgttctcttattttttttcacttcaatttgtcttttataagtgtcttgagtattcttacggtatcaagttgacaagtactagcattcaagaaattatgcaatctgcttttgtatgactttgtttgtagagccctaatgaatccatttactcatctattctattcttccatagaaatttattaaggatccactctttgtcagtcatggtgcttaacactaagcataaaaaattttaaaagacagaagttctctgtcctcccagatcatagatgaacaataaacaggtaacaaatggaaggattgattcatcattgcaaggttcataagctgggtatcatcatggagaatagaaaaatacaggtatctactttggatacagttttcagaagggggctctctggagcagtgacattaatttggggcaaaggatgagaagaaaccagccaagacaaagcttggcagaaagcaatcccggcagagggaacaattatgccaaaagcactatgtgggaagtaagtttagtggccaaggaactgagagaaagataaatcatactgagctttggggccataggaggtagactattacagtgagaagactctgaggttttgttaagcagatgagtgagtgagattaatgtttacatcagttacacttgctgctctgtagagaatgaataggagaggcagagagggagagaacttaggaggctgagagagcagcctcagttagaggttgtgaaggctttgacgaggctccaggggaaatatttttatgtttctgcacattcagggctttttgagtaaattttactggaacttgagacatggccttaaagagtaagatttggaagttaaattgcaattgattgaataatgatatgccgttcagagagatagtcctccactgcacaattattttatcctcatcttagatacatacatttgcactcacacacacacacacacatgcatatacatttacatttcaaagagtaagaaccaaggagacttcaaaagttgaatttgtttatttaaggagtaaacattttctctccatttctcaggggaggagtgaggacaactttccctctactatataaccactgtgattcatattttcatgattccacatctactatacagatcctgccttgtacgatgacatctagctctccaagaatcagagcaaagaatattcagtgaagtttgctatgaataataactaacctgtatgtgcctcaggaaacatcatgtttacattcataataatattactaaatatagatgttaaaaacttagcactgtgagaagggaggcaagatggcaaattaggcatagccaagaagagcttctcccaccaagagaaacaagaccatcaagtagactagcatattcccaacagatctttgaaaagaaggcattgagagtggatagaaagaggatacagacctggggctgaagcaggaggaagctgaaaaccctgcaaggggttgctgagcaccaggactcattttggccccaagcagctcccagggaaaaggtgagtttgaataggcatagagtggccccctctcatcacagacctccagaatcttagctgcagcagactacatgattctcatggatatttgagctggcagggaactgcccagagagttgatggagacagaattgtagcctgtgtagagcccaaagagtttgacatgggaacggctgcagtggatcataaccttaggatcccatcctccaaggcttgccatgctcctctaggtggctttagcctgtgttggctgctaaacttggacagaacagtgctatcttgtccatgggatgtggccaatatgatatgagtacccctctgtcttcagatctattatggggtccctggctgggtgtatctgcttgcagcgcagcctcagctgccaagccaagatgcttaccggcagccatcaccatagctcttttcatggcagacctctcctaacagttggatagcttctgtaagtgggcatccaccagctagtacccatgcacagccttcccccatcggcgtgcactcgcctgcagcctcctcctgctgcttttcaaatggatacatgcacatgggtcctgccatcacctaccacccccgcactgaagcacttttgccagcatcccccatcggagtgttgttgcaagtggactgggaacaccttgggtcctccagtgcaggaagtgcataacctcgaggggccagagaaaaaagccgtaagactggtcccagtccttcagggttagagcacaaatcctaggattgctgagctgagccttgactccgtgaaatcatccagaaataaagccgatcatctaaattcgacttataccacagccaaaagcaaaaagccccatccaaagtggcaattttaaagattaaggacacttcagcccaaatagatgaggaagaaccaacataagaattctggaaagtctaaaatccagagaacctccaaacaactatagtagctcccagcaatggttcttccatagactaaaatggctgaaattacagacataggattcagaatctggatgacaatgtagattaatgagattcaggagagaaatgaaacccaatccaaggaatctagggaatccagtgaaatgacacaagcaacacaagagctgaacgatgaaatagccattttaagaaagaactgaattgatcttctagagctgaaaaactcactacagtaattgtacaatgcaattggaagtattaacagaatagaccaagctgaggaaagcttctcagagctcaaagaccacttcttcaaatcaactcaaacacaaacaaattaaaaaaataattttaaaaaatgaacaaaacctctgggaaatatgggattatgtaaagagaccaaatctatgattcattggcatcctagaaagagaaggagaggcaagcaacttgtaaaacatatctgaggatattgtccacaaaaattttcccaacctcacgtgcaaatctagaaaattcagctaaattaaatgagatgctatacaatatgaccatccacaagacacgtagtcatcgtattctccaaggtcaatgcaaaataaaagatattaaaggcagctagagagaaggggcagatcacgtacaaagggaaccctatcaagctaacagcagatattttagcagaaactttagaaactagaagagtaatgcctatattcagcatccttaaagataagaaatcccaaacaagaatttttttattcagccaaactaagcttcataagcaaaggagaaataaaattctttttgaataagcacatgcttacggaatttattaccaccacctgcccttacaagaagcccttaagggagtgctatacatggaaatgaaagaccattacttgtcaccacaaaaagaagtatacagcccactagactataaagctactgtacaataaagtctacacaacaaccagctagcaacagaaagacaggatcaaatcctcacatatcaacattaaccttaaacccaaatgggctaactgctccacttaaagggcaaagagtggcaaacaggataataaaacaagacccaactgtatgctatcttcaagagacccatctcccatgcaatgacacccataggctccaaataaagaaatggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggtgggcgcctgtagtcccagctgcacgggaggctgaggcaggagaatggcgtgaacccgggaggcggagcttgcagtgagccgagatcccgccactgcaccccagcctgggcgacagaacgagactccgtctcaaaaaaaaaaataaaaaataaaaagaaatggagaaatatctatcaagaaaatggaaaacaaaaagagcagaggttgctattcttatttcagacaaaacagactttaagccaaaaatgatcaaaaaagacaaagaagagcattacataatgataaagggtttaatttgacaagaagttttaactattctaaatatttgggtacccagctctggagtactcagatttataaaacaagttcttgaagacttagttaactacactgtaacagtaggagacttcaacactccactgacagtgttagatatcatcaggcataaaatgaataaagacatttaagacctcaatgcaacacttcacaacatggaactaacagacatctacagaacaatccatccaacagtaacataatatacattctcatctgcatatggcacataatctaaaatcaatcatatgcttggctataaaggaattatctaaaaattcaaaaaatggaaatcatacaaagacactattggatcagagtgcaataaaaatagaaatcaataccaagaagatctctcaaaaccatataattacatggaaattaaacagcctgctcctgaatgactttggggaaagaatgaaaataaagcaggaattaagaaattatttgaaactaatgaaaacaaagatatagcataccagaatttctgggacacagttaaagcagtgttaagaagaaagtttatagcattaaatgcctacatcaaaatgtcagaaatatctcaaattaacagttctaacatcatatgtagaggaactagaaaaacaagagcaaaccaaccccaagcctagcagaagaaataaccaaaatcagagctgaattgaatgaaacttacacatgaatccataaaaaagataaaaaaaaagttgatgttgtgaaagcataaataagaaagacaattagctagactaataaagaaaaaagagagaaaattcaaataaatgcaatcagacatgacaaaggtgacattaccactaaccccacagaaatacagaaaatcctcagaggtttttatgaacaccgctattcacataaactacaaaacctagaagaaatggataaattcctggaaacatataacatgctaagattgaaccaagaagaaacagaatacctgaacagaccaagaatgagctccaaaatggaatcactaataaaaaatctaaccagaaaaagccctggatcagatggattcacagtcaaattcttccagatgtatacagaagatctcataccaaatctatggaaactattcaaaaaatcaaagaggaggtattactctgtaactcattctatgaggccagcattgttttggtaccaaaacctgacacagacacaagaacaacagcaaaagcttcaggccaatattcctaatgcatatagaagcaaaaatcctcaacaaaatacaagaaaatcaactggagcagcacatcaaaaagctagtccaccacggtcaagtaggctttattcctaggatacaggattggttcaacatatgcaaataaataaacgtgattcatcacataaagagaacttaaaaaccacatgattatctcaataaatgctgaaaaggcttttgattaacattccacatcccttcatgataaaaaccttcaacaaactgggccttgaaggaatacacctcaaaataataaaagtcatctatgacacccacagctaaaaccatactgagtgggcaaaagttggaagcattcccctggagaaccagagcaagacaagaatgcccacgctgaccatttctattaaacatagtactggaagtcccagccagaataatcaggcaagagaaagaagtaaaagtcatccgaataggaagagacgaagtcaaaccacctgtctttgcagacaatatgattctatacttactaatttccatagtctctgcccaaatgttcctagaactgataaacaacttcagcaaagtttcacaatacaaaatcaatacatgcaaatcaggagcatttctatacaccaataatgtccaagctgacagccaaattaagaacccaatcccgttcacagtcctcaccaaaagaataaaatatgtaggaacacagctaaccaaggaagggaaaaatctctacaagaagagttacaaaacagtcctgaaagaattcagagacgacataaacaaatggaaaaacattccatgctcatggataggagtcaatatagttaaaattgtcatacttccaacagcaatttacagattcaatgctattcctatcaaactaccaatgtcatttttgacaaaattagaaaaaagctattctaaaactgaaaccaaaaaaggagcctgaatagccaaagcaatcctcagcacaaaaaaaaagctggaggcatcacctgacttcaaactatactacaaggctacagtaagcaaaacagcatggtatttgtgtaaaaacagacacatagaccaatagaacaggtcagagaaccctaaataaatctacacacctgcaaccatcagatctttcacaaagctgacaaaaacaagcaatggggaaaggactccctattaaataaacggtgctggtataactggctagccacatgcagaagactgaaactgggcctcttcctttccccacatacaaaaatcaactcaagatggattaaagacttaaacataaaacctaaaagtataaaaattcctaggagaaaacctaggaaatactattccagacataggccttggtaaagatttcatgacaaagaccccaaagcaatggcaacaaaaacaaaaattgacaaatggaatctaattaaactaaagagcttctgcacagcaaaagaaactatcaacagcataaacaatctacagaatgggagaaaatattctcaaactatgcatccaaaaaggtctaatatcaagtctatagagaacttaaacaaatcaacaagcaaaaaccaaacaatctcattaaagaagggcaaaggacatgaatagacacttcccaaaagacgacatgcatgtggccaacaagcataggaaaaaatgttcaatatcactcattagagaaatgcaaatcaaaacagcacaatgaaataccatcacacaccagtcagattggttattattgaaaagtcaaaaaataacatgtttgtgagggtgcagagaaaaggaaattgttatacattgctggtggggatataagttagtttaaccaccatggaaagcagtttggatattctcatagaaatgaaaacaatctaccatttgacccagcaatctcattactgggtacttacccaaaggaatgtacatggttctgcattaaagacatttgcatgcatatatccattgcagcacctttcacagtagcagggacatggaatcaaccttgatgcccaccactgttaaacagcataaagaaaatgcagcatacatacaccatggaatactacagagccatcgaatgaatgaagtcatgtcctctgcagcaatgtggatgtccctggaggtcattatcttaagcaaattaatgcaggaatagaaaaccaaatactgcatgttctcacttatatgtggatgctaaacactgagtacacatgtacacaaagaggggatcaatagtcactgggaattacttaagggtgcagggtgggaggagggtgaggaccgtaaaactacctatcaagtagtatggtcactacctgggtgatgaaatcatttgtacaccaaaccttactgacacacaacttacctatgtagcaaacgtgcacacgtacccccgaacctaaaaaaaagaaagagttggaagaaagaaaaaaaacactgtcattggagatgacaaaaagttgaaaaaattaaaatatatttgtaaagagattccaaaaaaaaaaaaaaaaaagacctttctgatggattaaatgagggttgggggacaaaagaaaggagtcaatgatcactccaagttttattgagatgaggaaagactgagggaggaggaggttgtggataaaacaataaaattctgttttggtcaacttaagtgtaaaatatatatgaggcataacatcaagtttttaattatgcaattggatgtgcatatctctggctagaaaaaaaatcaacttgaagtcacactttcactcttttgtctcactgaaggctataattcacaagcatgttatgcttcctaaacgacagagctcagtgactactccactagtttaattgactgaagaggactgaaagaagataagaattccagaactagctcacaaactagtcttttgacattgaaggtgttagactggaaaacagtgaatatcttaatcaactctgtaattctgtgattctaattattttttaaatttttttcattaatgaatccatgttggttatataacgcaagttgcaactgtatccaaattgttcctgtaaagttaaactcaatctagtagactttctttctaagaagaaataatcagccaaagtttgcagacatcaacagttctggttaaaaaattgcttctaagaaaacacctcaatatttcactggtcttcaataactattacaatcaactattattctgatagttgactggcataactgagtagttctcatttgatttattgtgtagttgcattctgatgatgttttgagctgaaggcatctgaagatatccccagtcacattttcagtgcctgggatagaatgattagaagagacaggtgccagttggtcacctctccctccacctggccttttcatatagctagcatggatttgctaacagcctggggatctccagacagaggcttctttcatagaagggagaagctgcagtgactcctcttatttagtcacataagtcacacagcattaattttataatattttactgatcttaacagtctttggcccctccacattcagggagttttgagaaataaactccatctctgagtggcagaatggctagcttcgggaggggtggagaggattgacagtggttatcttggaaacaatctagcacatccctctgatcatcatctggtttgaatgaaaaacaatagttttttcatatctcagcctccagtcaggggtgctgaccagatggaataattagtgggctgctaaccagaacacatgttctaaggaagaatgtataaggctgattctctcatccagctgtgactcatacctctaaaaagcactccgaggctggcatacctgacagcaccctactttggtcatgtcctctcccatctccatacgtgctagcaccttcaatgtcaaaagactgattagtgaggcagttctggaattctaatctttcagacctcttcagtttaattaactagtggaggagtcactgaacaagtaggaagcatactatcttgtgaataactatagcctgtggtgagataaaagagtgaaagtgtggtttcaaattcccttaagactataacacattgtaatttttttttctagccagagatgtgcacatccaattgcataaatgaaaacttactgttatgcctcataaacattttacaagaaatggaaaccctaccatatttgcaatctgacctcccttgtggctaatcatggtttttccacttttatatttttgagaattctagagcacagaatctccccagtctactcaagaacagtagtccttaaactgtggtttgggtacacatggcaatacaggaaccgatggtgatacaggtaaccatggtgacacagaaaatcttctcatcagggtaattgcaggaagagttttaaaggaatccatttccagatccttaacatccatatgtgctctttgtcaaatttatctgcttgagaatgaaccagcattaatgaattctttcttttaatttaccaaaaataaataaatgataaactaacaaataaataaagttcttcacccacgctaaatcttacagtgatgttgtaaaatccaccagggcttcgaacaaagaagaaatggaaatgttggcttaaggaacattttagtatttaatttcagaaacataaatatgcaggatttcctgacttgatatgtattttggtgggggacaaagcttgctgtaaggtattttggcctatttgtcggtgctgtaaactcacatagcttaagcagcataagttagtgattctttgaaatgtagttggaatgctttaaagaaccatcatacatttcaaagtacattgtataaaacacatgggtaaaattttacataatgcatttcaaatattgtgtgtttaactcaatacacaggtgaaatcgtttttcaaattacattataaaatgttcatcccagttatatacattcatattatttcatcttgtaatagtttctgggtatcataaataagttatattaatttagactcataatgaaaatatttagatgtcaaattaaaatgtgtagagaatatgtagttttatcaaaattctcttaagggttgtataaactaaatgaaatgctacttatgctctatttcttatcactgtattcatctggctttattgaattacttgttattagtttgacttcacctttggaccgtaggtcacattactgcaaagataatatctgtctattatggctgtatccaagatacctaccacaaagcctcacattactagacattcaatgagtgaattgaatataagcatgaatgaatgagtgagtgcatgagcaaagcagcaggtatataaaacacagcagccttttcccttgtttaaacttttattgattattttctgagccacctactctactactttttgaggtttaatgcctttatcataatattatgtcatctattttgcaaagtgctataatcatattagctgaagagtgtatatgttaaatgctatttgactatttgactttttaaagagcagttatattgagatataatttacataccataaagttagcccttttaattttcagtgtaaaatttaatgtaaaattcagtggtttatagaatactctcagaattgttcagtgatcattactatctaattttagaacactttcattacctgaaaaagaaaccttatagcagcagtcacctccctctcagtttatgcaaccactaatctctgtttcatagctttgcctattctagacatcttattttatttacttatttttgagacagtttcactctgtcactcaggctggagtccaatggcatgaactcagctcactgcaacctccgctttctgggttcaaacgattctcctgcctcagcctcctgagtagctgggattacaggcatgcgtagccatgcttgttaatttttccatttttagtagagatggggtttcaccatgttggccagactgacctagaactcttgacctcaagtgatccacccgcctcggtctcccaaagtgttgggattacaggtgtgagctacagtgcccagcctagacattttatataagtggtactacacagtatctgatcttttgtgactggctctttcacttagaataatactttcaatattttttttcatgttgtaccgtgaatcaacaatttgttttttaaaactgatgaacaatattatattttatggatttatcacgttttgttgatccattaatcagttgatggacatttgggttgcttctacgttttggctactatggctaatgttgctctgagcatttatgtacaagttttagagggacatatgtttctatttttcttaggtgtatacctaggagcagaattattggtttacatggtaactctgtttaacaatatgaggaaccaccaactctattccaaattggcatcattcatgagtatatttttatggacttaatgaccatttataacacctttttgggggaattgttaattcaaatcctttgctcccaaaattggactgtctttttattgttaaattataagagttctttgtacattttggatacaagtctgtcatcagatatatgatttataattttttttcccattctgtattttttttcttttttcttttttttttttagacagagtgtcactctgtcacccaggctggagtgcagtggcgcaatctgagctcactgcaaactccacctcccaggttcaagcgattctcatgcctcagcctccccagtagctgggattacacgtgtgcgccatcacgaccagctcatttttgtatttttagtagaggtagggtttcaccatgttggccaggctggtctctatctcctgcctcaacctcccaaagtgctgggattacaggcgtgagccaccacgcttggccttttttccttttttttttttttttttttttttttgacagagtctcactctgtcgcccaggctagagtgcaatggcgtgatctcagctcaatgcaagctctgccacctgggttcacgccattctcctgcctcagcctcctgagtagctaggactacaggcgcccgccaccacgcctggctaattttttgtatttttagtagagatggggtttcactgtggtctcgatctcctgacctcatgatccgcccgccttggcctcccaaagtgctgggattacaggcgtgagccaccgcacctggcctttttcactttcttgatggtgtactcaatagcaaaattttagacaatttggatgcaatacagtttacctatgttttcaattatccctcatgtttttggtgtcatatctaagaatattatttaatttgttttttatttttatagagacagggtcttgttatatcgccctggttggtcttgaactccttgactcaagcagtcctcctcccttaggctctcaaaatgctggggttacaggtgtgagccactgggcccagcttgattcttaataattattgttgaaaataaatataagcattgccatgctgattaacttgctttctgtggctgccctcacttacaatgcaaattttacagactcctctagacatttagctggaactgccatgtgttttccctaaaaccagctcataatagagctgggctcaccataaatccatttcctactattcggttgagatctgcaggcacttttactttgtaaaatggtcttgctcacgcctgtaatcctagcactttgggaggccaaaggcaggtggattgcctgagctgaggagtttgagaccaggctgggcaacatggcgaaaccccatctctctgaaaaacacaaaaattagtcaggcatggtggtgtgtgccgttaatcccagctactctggaagctgaggcatgagaatcgcttgaacctgggaggcagagtttgcagtgagctgagattgcacactgcactccagcctgggcaacagagtgagaatctgtctcaaaaaaaaaaaagaaagaggaaaaagaaggaaaaaaaagcccttaggggaacataagtactgagagtcttagcaagcaaagaatacatgttttgagatgaaattgagggaaaatagagagtatagtgtatttcggaaaaggaaataagactggtttgttggaggacacaccagcatgatctctttcttattatccttgggatagatttcccaaatgatattctagcccctcagggcaacaacacaaaacacagcaaaaaaaagacaaaaaaacaaaaaacaaaaacaaaaacaaaaaaactcacagcatttacaggagtaaaactaattgtaatcatatgattcaaaagagcagtgcttttatactttcatatgtatacagattacctgttaaaaacataggttggctgggcacggtggctcacgccagtaatcccagcactttgggaggccgaggggggctaatcacgaggtcaggagtttgagaccagcctggctaacacggtgaaaccccgtctctactaaaaatacaaaaaattatctgggcatagtggcgggtgcctgtagtgccagctactcggcaggctgaggcagaagaatcacttcaacctaggaggcagaggctgcagtgagccgagatcatgccactgcactccagcctgggcaacagagcaagactctgtctcaaaaaaaaaaaaaaaaaaaaaatcagtcaggtagtgattaagcaggtatggaatggggtcttcaaaagcctacatttttaacaagctgcaggtaatgatgatgctgttggtcaggaaccaaactttaaactttaaataccaaagttgtggaaggcagaagggagcaaagagttcattccctccttcagaaggggagaaacattcactttgcaatcaggctgtgtttatcgagatgactgacattttttgcatgtgttcagacttaaaggtcagatctgtttccttctcagcagctgcgtgggaattgcttatctcgcactttctgtatggggtttgattacctaagtgaaccaagaagtttcacaatattttggagaaaaacacttctagtagcatccaacatgcaacattttaaaccagctatgaaatggcaggcttacaaagtcaacttggaatcacatctctggtccaggcaaagggaatgaaaacccagagactatctccccgagagccctgtagctgtgtgtgaatgtgtacgtgcagggatatggactgtagaccctgttacaaatactaaatatctgtttggaagaaggctgtcctcacatgtgccgctaaaatcatccacaggctagtcttaggccaaacggtaaaaggaaagaagcctatccttggcaattattcaagcagacagtctgacaagctttcctgagtgtctagtacatactaagcacggtattcatgtcccaggtacagagattaacaagtctctgatccccaatgcacatggcttgatgggaagtctggcattgaaatagacaattgcaacattgtaacgtgtgtggtataatagagatatacacagactggagagaggtccaattcagcctctggaggcagaaagctcaggaataacttctcagatgtgatgcttgaatttgttgcccattttttttatttttcctcccaagtgcctttataccatttaagggactcttctgcaaagaagacggaatttaaggtaacttcttcacttggtgttattgatggtggcatatgatacttggtccagataacgggcctgaatttccaaaggtattcaccactgcgagctattcttaaaatctaagaatgaattgacaataatagagtttcacctactaggaagacagatcatttgggggctagagtgcttatgttccagtccttaaaagtcacatcgctggaatgactcctgatgtttgtcagaagctggatcagatcacaaaagcccttccttggagcaagaggcctccgccaggactgagctcatttacttgacctgaccctgaatttccgtagtggagacaagcctcaggaaaatactaactgcctgctgtgttcccatactacaaaagagtgatctgtagaagtgacaggtactttccccctctgggagagaagggtccatgtgttctcctgcctggaccctctagcaagctacttaatatggaatcacacccctggaggagataggcaaacccttgaacagccaggtcaaatctaaaaggcaactgcctctagctgcagaggcaggtggcagcttaaagtggcaccaagtcataaaatgatttcccttttgagcttgggggaagatacaattttttttttttttttttgagacagagtctcgctatgtcccccaggctggagagcagtggtgcgatctcggctctctgcaagctctgcctcccaggttcacgccattcttctgcctcagcctcccgagtagctgggactactcgggcccccaccacgcccagctaattttttgtatttttagtagagatggggtttcactgtgttagccagaatggtctcgagctcctgacctcatgatccacccacctcagcctccaaaagtgctgggattacaggcgtgagccaccgcacctggccaggggaagatacatttttaagcagcattccaggctaatatgggagtacatggatgcaacactgtatctcatgctggattagcagccctggaaaccagagctgtctcttaatcaagactaggtattgtgaacccaggtaatctgaggcaggtctcagttaatttagaaaggtttttttttttgccaaggttgaggacatgtccatgacatctgcccaaggttgtcagggcatagcttggtcttacacattttagagagacatgagacatcaatcaatatatgtaagaagtacattaattcatccagaaaggcagagacaactcaaagcaagcctccctccccaccctgagggacttctatgtcacaggtggatgagacacaaatggttgcattcctttgtgtttctcataagtctttccaaagagggcaatcggaatatgcatccatctctgtgagcagcaggatgactttgaatagaatgggaggcagatttgccctgagaagttcccagcttgaaagggcccaagacattttcctttcacagtatcttagtccattttgtgttgcaataaaggagtatctgaagttgggtaatttataaagaaaagaggtttatttggctaatggttctgcaggctgtacaagacgcatgacactggcatccatatgctcagctgctggtgagggcttcaggctgcttcaacttgtggcagaaggcaaaggggagccagtatgtgcagagatcacaaggcaagtagggggagtagggggaggttctaggctctttttatcaaccaactcttgtgggaactaataagagtgagatttcaccaaccctccccaccagggaaggcattaaggtattcacataggatccacctccatgacccaaacacctcccatgaggccccacctccaatctccaacttatgaggtttggggagacaaacatccaaactacagcattttgcccctggccttccaaatgtccttctcactttgcaagataaaatcatccctctccaataggcctccaaagtcttaacttgttccagcatcaactcaaaagctcacgttccaaagtctcacctgagactcaagacaagttccttagagctgtgagctgtaaaatcaaaaataagttatttgctttcaaaatacaattattgtacaggcattaggtaaagattctcattccaagagggagagatgagccaaaagaaagggataacaggccccacacaagtctgaaaatcagtagggctgacattaaatcttgaatctccagaataatctacattgactacatgtcccacatcctgacacactggaagaagaggtgggctcccaaggcttagggcagccctgaccccatggctttgctgggtgcaatccccctggctggctgctgtcatgggttggagtagaatgcctgtggcttttccagcctgagggtacacggtgccagtagctctactattctggggtctggaaggtgatggttctcttcctgcagctatactagatgtggtcctagtacaggctctcagtggtggctatgcttctgcagcaggcttttgcctgggcaccacacattcccatacatcttctgaaatctatgtggaagcctccaagctttcaccactcttgcattctggacatctacagacatagcacgaggtgtatgcttccaaggcttcctgcttacacaccccagagtggcagcctaagccatgcctggggctctttgagctacatctggagctggaacaacaggagctatcgggggaaccagcccccaatatttcaacgtaggttcttttctattttccctaagtgtcagctggtctgagaaataaagagaaagagtacaaaagagagaaattttacagctgggcctccaggggtaacatcacctattggtaggttctgtgatgccccctgagccacaaaaccagcaagtttttattagggatttcaaaaggggaggtaggtacaaacagggagtaagtcacaaagatcccatgcttgaacggacaatacaagatcacaagggcagagaggcagagcaagatcacaaggccagggcgaaattagaattactgatgaggttccacgtcctgctgcgcacgcattatcattgataaacatcttaacaggaaacggggttcaagagcagatgaccagcctgactagaattcgccaggctggaatttcctaatcctagcaagcctgagggcattgcagcagaccagggcttatttcatcccttgtcttcaaccgcataagacagacactcccagagtgtccatttagaggcctccccctgggaatgcattctttcctagggttattccttactgggaaaagaattcagagatatttctcctatttggtttctgcaagaagagaaatgtgactctgttctgcctggccccataggcagtcagaccttatggttatctcccttgttccctgaaaatcgctgttatcctgttcttttttaggatgcccagatttcatattgttcacacatgttttacaaacaatttgtgcagttaacgcaatcatcacagggtcctgaggcgacatacatcttcagcttacgaagatgatgggattaagagattaaagtaaagacagccataggaaattataagagtattgattgaggaagtgataaatgtccatgaaatcttcacaatttatgttcagagactgcagtaacgacaggcataagaaattataaaaatattaatttggggaactaataaatgtccatgaaatcttcacaatttatgttcttctgccacggcttcagccagtccctccgttcagggtccctgacttcctgcagcagggagcagtatcccagggaggcacaggaaattggaaccccaaacatgtccccagaatctattctgtcctcctaagcctctgggcttgtgatgtgggggcagcctcaaagatttctgaaaagcctttttgacctttttttctattgtttgactattagcacctgactccctttagtcacgttcatctcttagcaagtggttttactgcagtacccttggatttctctccttaaaatattcttctctaccgcatagccaggctgaaaattttctaaatatttactctctgcttcctttttaattataaattccatctttaggtcatttcctcgctaccaaatcaggttgtaagcaattgaaagcagccatgtcacttcttgaaggctttgcaccttagaaatttattctctcagataccttagaacagcattcttaaatttgtcctttcattaatcccaagggcataaatgcaatgcaggaaagttctttgctaaggctaataaggatgacctttgctttactttccagtaagttcctcatttccatctgaggtgccatcagcataacttttactgtctatatttctatcagaattttcatcacaaccattgtcttagttcatttgtgtttctataaaggaatacctgaggctgggtaataaattttttaaagtttatttagcttatagttttgtaggctgtacaagaagcatggcagtggaatctgcttctgacgagggcctcaggctgtcttcaatcacagtggaagatgaaatggagctgttgtttgcggagatcacatggtgagagaggaagaataaaagcatggagatgccaggcccttttccacaactggccctcatgggaactaatagagtgagaacttattaactactgcaagaatggcagcaagcagttcataaaggatttacccccatgtctcaaacacttgccaaaatgctccacctccaacaatggggaccaaatgtcaacatgaggtttggagaggtgaaatctccaaactataccaaccacttaatgaatctctaagaagtttccaactttctcttgccttattgtgttttctgagtcctccaaaatcttacagcctctgcccatcaacccgttccaaaaccacttccacatttttaggtatctttatagcaacatctcattccttggtaccaattttctgtctttgcttgtttgtgttgttataaaggaatacctgaagctgggaaatttataaggaaaggggttttgtatggtacattgttccactgattgtgcaagaagcacagcactagcatctgcatctggggagggcctcaggctgcttccactcatggcagaaagtgaagggaagccaacatgggcagagatcacacactgagagagaaagtaagatgcagtgaggccatgccttgctctttctaacaaccagttctcatgggcactaatagagggagaactcattaccatgaggactgcactgagccaggccaagtcattcctggggtgtccgccccaatgactgaaacacctcccatttggccccacctccaacatcaggatcaaatttcaacatgagatttacggagacaaacatccaaactatagcactgggtaactgggtggcaaagagtgtgtatgattggagtagaataatcaggggacttaggagtatagaccaacattagaaatctgctgccatttactaactgcctgtcctttgacagtaagttaaccaagctgcatgtcaggatcttctgtgaaaaaaaggagtaatagctgcatcagttaaggttgcccagtaaaatgttggaggtccagttaaatttaaagttcaaataaagaacaaataactttttcacataagtgtactccaattgttgcatgggacataattatacaaaaatttattcattgcttttgaaatccaaatttaacagggacattgcctttctgttcgctaaatctgacaaccttagagttcatcaggataggctagtttaagccaaagtaatatttagttttagaatcttgctggcaaattctattaaacaatttgttgttcattaagtgtcgtccccagaaaagcagcatctgtgtgtcctagaaacatcggaaatgcaattttagacctactgaattagaaactatggctatagagccaggcaatttgttttatcaagccctccaggtgactctgatagactaaagtttgaaaactactgcacacatttgcagaacatctaaaagctaaacatttttctgtcctgtagcccaacaatttcatgactaagtatataccaagagaaatgagtgcattattcactaaaatatatgaatggagttttcataacagctttatatacatcatggcccatggctgaaataacccaaatatacatcaacaggagaataaataaattgtggtacttagaacatggcacaaccctaaaaagaacaaattttttatatgtgaaacaatctgggtgaaaatttacagacaatattttgagtaaaagaaacacgacacaaaagaatatgtatgttctatgtgattttatttatatacagttcccagatcaggtgaatctaatctattttaatagaaatcagaatagtgtaactggggttgggatgggtggctgtattgactgggaagagaaatgaaatcttccgaggtgctggaaatgttgtacatcttcacctggttatggttatactggtgtatttagatgtatacatttatacatgtgttcatttaagattaatacaccttatatatgttatacctcaaaaagagaaaagaaaaaataactaatgaaacaaatctcagtgcctaaaagaataaaaaagtatgcctcactcctactacttactactttaagcttccatcacctaacccggggcaatcatttgtgtggccttatctatctttaagtgggaaaagcagtacatccttcatagagggagaaagagcagaatagttatgaactatcttactgactccaacacacctacttcttgaagttctatgtaatagacatagtctcatttattcatcctctttttttaaaaaaaacttacactatgaacaaagcactatgttagccatgtgagattcagtgataaaataaaatggtgttgctcttagggagcttatattcaaagaagaaagacattaaaagagattacataaataactagttagaattatgatagatccagtaggattttgaccacttgccttcatcattttcttaaggcattggtgctgcctgggtacctcttttgcaaccaggcaacatcagccaagatatgcatgacacaatctgaaacatcctttctcaccctcttcaacacctcagcagctacatgagccatcaccagttcataaacggggtaaaaagtagaactgtcctagccagtagtttagtggaagacactgagattctaaactgcattagaagctgaatgcaaaattcaaaatatttcagcaggcaaaagaaagtcaaacagggcttaacattcactactggtcctctgaaagcccatgatacaaccaactattgcagttgattgactaaatttgcaagagtagaagaaagagaaatgtgaaggcagaaaagcaacagcaacaataaaaagtatcaaagggtgagagctatatgataaaaataactagaagaatagccaaacatttggaagagaggttctcttacttggtcatccatcagaattgccttggggactgtttacaaaggttgtcgggccctacccacagaatttctgattcagtagatccagagaggggcctaagaattttcaccgcaataattctcaggtcatgctggtgtcgttagtcaccacacattgagacattgctgaacacacactgagaattgctgatctagaggaaggaaggaaatgtaacactgaactgctctcactttccttctattttgaacaagctgctattattctgaaacagaaaacttagacgttctgcctactaatgctattattttttcaagttcaccattaaaatgtagggatgtggtaacagctgtgaaacctcttgcactacactgggtcttccttgagtccactacaaagaaataaatcagtgactcttttcttctttattcttcagttgacccttgaacaaagaaagggttaaggatgtgaagttcaggctcatctctgaggtaaaaatccaagtataacttttgactccccaaaaacttaactactaatagcctcctttgactggaagccttaccaataacataaacagttaattgacacgtgtattgtgggttacacttattgtatactatattcttacaaaaaagtaagctagagagaagagaaaagaaaatattactaagaaaattataagaaagagaaaatattcttactacacattaagtgggagtgaaacatcataaaggtcttcatcctcatcatcttcatgttgagtgggctgagaaggaggagaggaggggttggtcttgctgtctcaaggatggcagaggcagagtaaaatctacaaataagtggacccctgtagttgaaatctgtgtcattcatgggtcaactctgtgtgcgtgtgtgtgtgtgtgtatgtgtgtattaattcggtttagactacaaagggcaacccgctctccaggaaccaagactgatgctggatgatgccatatatacaagatggcatataggaggtgatcatggaggaccttcagtagcagaggctaggaaccacagggttgaggggaggaggtaagtgaaataatggggctaggctagaatagaaagtagtatcatagcgttcatttttatattgcaaatatcttttctctgtgcccttataaaataatatttaaatgtgtttttaatcagtcctaagtaattggcaaattattacatcatcatcataatcatattttctcattcatggaaaagatatttactgagcctttaatgaatgccaatcactgtgcaggttttagagattcactcgtgaatgaggtaaatctactccatgtacttaactgatagagatttaaaactatactcatgtaaccatgtcattcattcccctgtcaggacaaccccgctgcttcccattttcattcctctacatttaattacaacccggtcttctactctaatctctccctgcgatcttgatctatgagatacttgccccttcgtcatcgtttcccttctgttgaaagcaaacctcctctcaatgcctgtaagccccattcaccttatccattctataaggatcatttcagcccttatttttactgaagcctcttacctccactttagtccaaagtcggaactctttctaattttctgtaggacctaatgtgcccattaggcatttaaatgtacacattcagtattgaatttttattgagccatgttatgtgtaagtagtattgtccctttgcaattttcatctatcagaattatggataagatttgctgtcccttcataaaattgtgtttccatggtagtgtcatttaaaggtgaatcattttctcataggaactatgagtgcaatttggtggctgccttttaaaaaataggctaattcagtcattctcaaatgcagtcttgatcagaaatgatcctttcggttatttgctcaagtgtgtgtgtgtgttcaggtcccaacccaagaccaactatctcagaatttccaggtaatctcagaattttgagataacatggcctgaggatctatcttttaaacaagtgcctccagacaatcttacgaagaagcaagtttgggaaccttctggctgcacattaaactaaaaaactgaaggtttttttttttttaaatcagtatcctagaataattaactcaaaatctccaaaggtgaggttttcctggcatattttcttttctatttttacatctttctgtgacatttatttatttatttgttttaatttattttttatttcaataggttttgggggaacaggtagtgtttggttacatgaataagttctttagcggtgatttctgaaattttggtgcacccatcacccaagcagtgtatactgtacccaacatgtagtcttttatccctcacctgcttcccaccctttccccaagtccccgaagtccattgtctcattttatgcctttgcttcctcatagcttagctcgcactttaagagtgagaatgtacaatgtttggttttccattcctgagttgcttcgcttagaataatagtctccaattccatccagttgctgtgaatgccattattttgttcctttttatggctaagtagtgttcgatagtgtatatatatatgtgtgtgtgtatatatatacacatatatacacatatacacatatatacatatatatgtgcgtatatatacacatatatacgcacatatatatacataaacatatatatttttttatccactagttgattgatgggcatttgggctggttccacatttttacaattgcaaattgtgttgctataaacatgcatgtgcaagtatctttttaatataatgacctccttcctctgggtagaaactttgacatgggattgctggatcagacggtggatctacttttgtttctttaaggaatctccacaccttttttcactgtagttgtactattcactatacactattacagtgtagaggtattaactttttactgcatccatgccaacatctattattttttgattttttgattatggccattcttgtaggagtgaggtgttatcacattgtgattttgatttgcattttcctgatcattagtaatactgagcatttttacatatgcttgttgaccatttgtatatcttctttaaagaattgtctattcatgtccttagcccactctttggtgggactgtctggttttcttcttgctgatttgtttgagttctttgtagattctggatattagtcctttgtcggatgtatagattgtgaagatttttttctcactctgtgggttgtctgtgaactctactgattatttcttttgctgtgcagaagctttttagtttaagttccatctatttatctttggttttgttgcattggcttttgggttcctggtcatgaagtctttgcctaagccaatgtctagaagggttttctgaagttatcttctaggatctttatggtttcaggtcttagatttaggtctaatccaacttgagttgatttttgtataaggtgagagatgaggatccagtttcgttctcctacatgtgacttgccaatcatctcagcactatttattgaatatggtgtcctttccacactttgttttgtttgctttgttgaaaaaaaagttgcctgtaagtattcggctttatttctgagttcagaaagtgggggatgtgaaggagcaggaaagatctgcaggactgtcatcagggccagactcgctgcccagttcaatcctctggaaggctgcacagatcccacctgtttacccttaaggtttcacgccctcttgaactctctcttcaaagttctttccaactttctcttgtggcactggttgactattggtcttgtgccggtctttagctttaattggagtttaccaccaattaactgcactgggctgcattcccaagcaacctgactccaggaagatctgggctggttcaccttttatggccacactactctgaacgtgcccaatctcttctgatctcggaagctaagcaaggtcgggcctggctagtacttggatgggagacctctgccatattttctaaaagccgtctttgttccgaatgggcaactaagttaagaaccactgcatagtgtaacttatgagcaagattgctgaacagtcagtgaaaacagggagtttagtacaaagtctcttcatgtatatttcctccatagaagatgtgggagaaccttaaattaaaagaatactcaccaactgccaattcatttcttgtaagtaacatatacacatttcagacaaattggaaaactgaaaagtataggaaagtaaataaagtcactcattaagtcagcattccccatgagcactgtaatctatttcatcctaaccattttatccacagactatatacacatctcccaactgtcggtttgtaacaaaattggttttatttttgtgtactattttaacatacctctttctactaatatagaatatgtattttacatgttacttttttctaaaatatgatattaaggaatatccattattaaatgggtataaaaattgtttagctaaaacctatttctgtaggtttttccattataattaatgccaccataaatattggtacatagggttttatatacgccactggtcattttccagcattattgaagaagataaatataataaaacatacaactctttgtcaagtaaccagaagtggattactgagttaatagatgatcaaataatttttattttctcttcagatatatagtagcagcttagcaaaaattcatggagatatctttttccattgctgtaatgaacacaatttattacaaatatattttaattggctaattttccaagtgaaggagttgtacttaatttatttaatttgtatgactaagaagtgacatttttccttaggcatttgtctaattcttccttttgcaaattgcccatttacactttgtcccttttttttttttttttttggtcagaggagactttttgcctcattaatttgtaggaaatccttacttagtaagtaatagtaagcttcttatcccttttttgctctcatcatcatcctcccacttttaaatcttttgttattttttaaactttaatcaaagttattagtccttggggagagatttctagcttttgatattatatttgcttttcttaatccaaattcagatatttattaattcatttactttctaactttcctgtcacttcatatgtatatttcccatacttatgagtgtgtatacagaaatacatatgtgtgtgcttttaattattctagaatgtattgcaatagataaatgtctactgtatactatattcttagaaaaaaagctagagaaaagaaaacattattaagacagttataagaagaagaaaatattcttactagtcattaagtggaagtggaacatcattaagatcttcatcctcatcatcttcatgatgagtgggctgaggaggaggaggaagagcaggtgttgaaaggggggggtggttaggcatcctcttgttcatttttagaaatattcatttccctcagtgctatttacaaaataatttcaactatttcgctaagttgtgtactgcctttattatatactaaattttttaaattcttttttcctccatttactatcttgttttattgacctgtcttatcctgacacctgtttcacattgtttaaattattgtgactaccttaatagatatgactatcgggatgcacaaaacctacctacttttgcttttataataaatttaagcaattttgtgtcaaacttaagatatgacttaaagataatgaaagaaaaacccaagatatagttaaaatctgtcaattttaattgatatcaccaatatttaactgaaattctcctcttaatttttaagaaacttacttcacttttgtccattcatgttgtataaacaccttagaacttgtgttcacatgtctttggataatttctgtgatttcattcatttctcaccctgtctgcttagagggtggctgtggactttacaaaatacttttatttacagctatggctcataccaaatatgttttagtgaaataaatatttgatttcagtttgtatatcttatataaaaatataatccataccaaaattttctagaacacatttattgcacaattgaagcctgttagtctacagtggatcatgaaatacaggcctataataatctaattgctatccatagtaagagactcttctctggtctcttgcagtgtgtgcttatctaccttgtttatgtattctgccaacttctttaagtctgtattttaatccctagcagttgggtaaacattcataacgtgtgtgtaacaattatttctgaactgctctcctttcaaaagcattgataatcgaaggttaatgcacaatcgaattttttccttcctggatcaagcctataactgtaacactgtgaaactctcagaaattgctctattacaccaagaagcttacactgctctttgacacacaacactttggatggtctgactatcttgttatgttccgattgctacagtaatcagttagaggccagacacatgttttattataagagcaaacagagtgtatctgctctagggatcagagagagagaaagataccagatttgacagcagcagacttctaaaaacagactgacctgaaatataaatttctggagctagagtagttagtgttgtgacaatcagtttacatctaaataacagaatctacaccagagaccactcagcaaaaaaaaaaaaaaaatggtgttttaataagattcttgcgggtttgcatttcttcagccaatacacagcatagcaaaccccagatcaagatatgaaactttgtctttaccttgtgttgagagaatatcacttaggtggaaaagaaatgaaaacgtcaggctttgataatatagcattaaatgataaactgtactgccgagaaagcaaagccattatgttaacagaattgtgcattactatgacttgtgtttactcctgtgctgcacacattttatcctgcctgtgaattctactctctggcctcttaaaaagattaaaagctgtaattttttcttgaatatatctcctaagtcactaattacattccctagactcttacatccttattcatgtgaccatttcttgtattttacaatgggactattgtcagcttaacaatctagctgtaatacccagggaaggccacacactctcaatgctaaatcacattaccgaatacttttttcttagaacttgttttatcgaccacttgagaaggtttaattgtaaaagtgctaaatgagaatcgaaagaatttgttcttttttcttaatttgaagttgctttgcttaaacatgtaatgatgcctgtgatatgcatggcatcaaaataatgcatagacactattcaaatctctgagtgacatgtgtcttaggtaccaatcttgttgtcaaatgttcactcccagggtatttgctgaaaggcttggatttcatttagggactcagttcctgttttcttcttctcaattggataccattcagttctaaaatctaaagatcaaacagttacccagaggagcttctccatgaacaatcactctttattccataaatgatccagatgttcccaggaaattagttattccttggatattacaagttaagtgaaagattattttctaggtattacactattggggatacattgctaataagcataataatattatttaaaatatctggaggatttaatgatctccagttcattttaaatttttatatgcaggaataatatagttcagtgatcctgaaagttgccgtattgcaacagatgttaaattgttgagattaattcaatgtcatgaaaatatgctcttagcagaaaacaattagctgccattcacttaccatctataccaggtaatagactcagtgttgacaagcaatcaaaaaggcacattcctagttgctattatgaggcttgtattcattctgtcacacctgtgatgatctctataggggtgctgagaaacatgaggacgtggtaaaatttcagaactatgtattcagaaaggctttgggaaaaacatgaaatcaatatggagactatgataaatgtagctcatatgacctctgttctgaacattttgtcagatcaaaaagtatgatatgttggccgggtgcggtggctcatgcctgtaatcccagcattttgggaggctgaggcggtcagatcatgaggtcaggagatcgagaccatcctgggtaacacggtaaaaccccatctctactaaaaatacaaaaaattagccaggcgcggtggtgggtgcctatagtcccagctactcgggagactaaagcaggagaatggcgtgaacccggcaggtggagctagcagggagccaagatggtgccactgcactccagcctgggtgacagggagagattctgtctcaaaaaaaaaaatgtgtatatatatacatatatatatatatatatatatacacacacatatatatatacgtatatatacatatatatatacatatatatacacacacatatatatatatacacacacacacatatatatatatatatatatgatatcttgatatctgtatcccatcattaaatattttggccaattcaattggttcattccgcatgggaaggatggttgaaagattgtggccaggaagaataagtcaatctgtcttttgattacatagattagccatttttttttcaaaattgttgtttcagtagtcggaatccctggtgcagctactctaagatctgttcctatatgcattattatctgcaaacattcctacattaattgacttgcccctcagtcaacttcaacatccattgctcttattattgccttttactataaatatattagtgaccattataccttgctcagtgtaacagaaattatatatgctaaagaacaaagtttttatgagcaattacttagaaacaccttagtaagtcatgttttctaaaaattaggaagataactgaattagagtgaaataattattgtctttcactctttgtaaaaatgaactgtttttcttttgtttattatgctttaagttctggagtacacctgcggaacatgcaggtttcttacataggtatacgtgtgccatggtggtttgctgcacccatcaacccatcacctacattggatatttctcctaatgctatccctcctctagccctccaccccccagcaggcccaggtgtgtgatgttcccctccctgtgtccatgtgttctcattgttcagctctcacttacaggtgagaacatgcggtgtttggttttctgttcttgtgttagtttgctgagaatgatggtttccagcttcatccatgtccctgcaaaggacacgaactcatccgtttttatgtctgcatggtattccatgtcgtatatgtgccacagtttttttttctttgagacggaatcttgctctgtcacccaggctggagtgcaatggtgctatctctgctcactacaacctctgcctcccaggttcaagtgattctcctgcatcagcctcctgagtagctgggattacaggtgtgtgccaccacgcccagctaatttttatattcttagtagagatagggtttcaccatgttggtcaggctggtcttgaactcctgacctcatgatccacctgcctcggcctcccaaagtgttgggattacaggtgtgagccaccatacccggccatgtgccacattttctttatccagtctatcattgatggtcatttgggttggttccaagtctttgctattgtgaatagtgctgcaataagcatacacctgcacgtgtctttatagtaaaatgatttataatcctttgggtatactgtttttctgattataatttaagtcacaaatattatagaaaatacagaagttataaaagtattttaaaaatcagccatcactctaaagaaaaccatcattaagatgttaacatatttcttttcattgtttttaaaaattgttgagactataatatatgaacaactgcctcactgcagttacataaaactttatagcaccgtgttttcttaggttgttattatccgactttcaacataagatgttatggctgcacagtgtcccattgtgttagtatgtggtaatttagttagcttggttttttatcttttttgctatcataatataattctatgttaaatatcttagggtaattttttaaaagttcaatttctttatgtgtaatagtttttcaggagtaggatactttgaatttgtgcattaaacatattcttgaaccaagactgaaaatgttctttccctgggtatgcacatttaaagtagatatttccttgatgttgcaaataatgtaatttatagacatatttcacatttatagaccctacactattaataatatgattcattattacaacagtagtgtatatagattccaaatccatttcaacctttaccagctttggataactggtctaattttacaggagaaaaatggtgcatttcataagcatttcttttctctgatactagtgaatttgattcatgcagttgtttgttaaacatccacctttcatatctttaaatcagttatttgttttccatcctctacattttgggcattccttcccttaataagttttgtgaattatattttttcttatccaaacattgaaaatatatggtcatcatacttttaatcaggcatcatttgttttactaaaggaaactttcttgagccttaggacagtgttaaagacttttctgtttctataggaaccatataacgtaacaatgactatcactgaatgagcgctaaggtttttacattaggcattttacatacactatctttttaagtcctcaaaacagcactacaaaataaatattgaggttgaaggacgtttaatagctacaggattttttttgttagacttgattttttaaatattcttatccagtttcataatcaggagtttttgcaatgacttaggtgaatttaaaaatgtccccaagaatagacataagttgctagaacaaaacagcttagaaatagatccacacaagtataatcaactgctctttgaaaaaggagcaaagatgttgctgcaatggagaaaaggttagtctcttcaacaaatgatattggagaacttgagtgtccatatgcaaaaaccagaacaaaagcataaaacaaaacacctagacaccaattcaaaataaattgtatacctacaggttacacgtaaaatgcaaaaccaaaaaattcctagaaaagcgtgaagcagaaaatctatgtaaatttgtgtttggtggtgatattttagatacaatactaaaagcataatctgtaacaaattgatacgttgcattttattaaaagtaaaagcttctgctctctggaagataatgttaagagaacgactagacaagctacagactggaagaaaatatttgtaaagtatgtatctgataagggattgtatgcaaaatatacaaagaaatcctacaattcaacaataaggaaacaatcaatttttttaaatgggcaaaagatctgaacagacatctcaccaatgaaagtacacagagggcaggtaagcatatgaagactctcaacatcattttattggaaaattgcaaattaaaacatttgtagcttcggccgggcatggtggctcaatcctgtaatcccagcactttgggaggccgaggcgggtggatcacctgaggtaaggagttagagaccagcctggccaacatggcaaaaccctatctctactaaaaatacaaaaaattagctgggcatggcggcggacacctgtaatcccagctacttgggaggcttaggtgggagaatcgcttgaacccaggaggcagagattacagtgagccgagatcccaccattgcactccagcctgggcaacacgagggaaactctgtctcaaaaagcaaaaacaaaaacaaacaccatttgtagcctcacagtggagaaacctcataaacattaacttagccaggtaaacaagatcataatcaatagtaatgtcatattgataacatgtactctaagccaagtccaaacatgagaaaatatcaggtaaatcccagatgatgacattctacaaaacacctgaccagtaccactcaaaattgtcaaggccatcaaaaacaaggcgtctgaaaaactgtcagccaagaagaacctgaaaagacatgtcaactaaatgtaatgttgaacactgaatggatcttggtacagaagaaagaacttaggtataaaactaagaaaatcagcgtaaagtatggactttgctaaacaatagcctattgatattattaattgtagcaaatgtaccatattaatgttaaatgctaatgataggggaaagtgggtgtggactatatgggaattctatatagtatcttcacaatttttctttaaatttaacactattctttaaaaagtttttttaaaggaggatctaatggatatggagttttagttttgtaagatgaaaagttctagacctgttttacaatgtgaaaatatgtaacactactaatttatacactgaacaaatagttaagatggtaaattttctgttttcttccacaattaaaactaaaaataaaatattttaaaagtctctaaaaaacaagtaaataaaaatatcccctattcatgtaatgtttctcttttatactgttaatgcagtgaattatgttttctgagtttttgtgtaaaaccaatcttgaatcctagcataaatccatgttttattatcctttttatacatcaatagatttttcttgtttatatttcatttaggattttttttgttcctatcttaatgaaacatagggaattttcttcttatttctcggaaggttcttgtcaaaggtttgtatcaggattattctagcctcatagaatgtattgggatgtgttcctttctttcttttttgctgtaagggttatatagaattggcattattcttcctttaaatatttggattatttttccaacgaagacatgagtttgtagttttatttctgggaagaatgttaaatgtacattaaatttcataaacatatctagaaatatttacatgttccatttctccttatgccagtttggttaagtggtactttcaagaaatatgaacatttcatctaaacgttcaaacgtattgcatggtttttatctgtttgtttaaccacttaaacctagagagctgtgtcaaaatattcaagtgaattttttttttagttctgtgtcctttttagttgatcatttgctgcttcatatattttgaggctaatcagcaacctgcgtatctgacctggattggtgattgttgttcctttatgttagctttatttatcaaaatataatgtccactttgataacacaaattttaatttttttttctggtaagcacaataatctaacattattttccatattggcctaatacacaattttttccatcgatgaatctcttggtgttttttttttaattgatcatttataaaattatttgagagtcaatttttttatgtgaatttgagtttcaggtcggtcataattgcatagtcatatttattactactagtttatttccctcaaataaaataagttccgtcatattggtcactacctattctccatcctcattccaaaacaagatttgttgaaaatctcttgtcattgttttggttaacattacaatttcaaaagttaataattttttatattcctcatatttctttgtttttaactgtagtgatttctgataaaaggcctttcaaagagggctttagttagatgacatttctgagtctgagttaactctaaaaacatacttatgtttttaaataattttgatagatacacattttaagttcaaagtgtgctttttttcctggacatgtacttcttgtttgtgactgtgaagctcttttcctcaggaagctttttgaattttcctttggctttttgtgttattgaatgtaatttgatatgttcataagtctcccctccccaccttatctttttgtttctgtatactctgaatcattttaatctaagatcttatagctctctttagttttaaaaaattattggtcattaatccttcaaatattcttctctttatatatttttccctcctggactattattaattcaatactgacatttctatatatatattctctacatctcttaccttatgtttcttctattctttttatttccttatcccttccagttgcattctgggagcgtgctttgacttaattgttcagctcactcgtttgttctttagttgaattcatttgacagttcaatccttcaattagttaattaatttaatttttaatgctttatacccaatgtttctatttgttttttctttagaaattctcatttttacttgacatttccaatattatttcttatctctacaaagataattattattcctctttaaaattttatattttcctgcatcttattttacccttatatagtttgtcttaaaaatcctgctcatcagctgtcttgaattgttgtcctatggttcattgtctctgggaggtcacagtcacttatactcctctcaatctgggaaaatgtgaaaaattcagaccttatttttttccctttttataattttaaataattaaacatttcaaaacaaaaatctaaaatatcaaaatgtagactgaaccacttctgtttgtctgcctcataccactgaccatccttcttcctcagggatcttgcttgttttttgttactatcttgtcaagtaccaccattctttctgaggaaggagagagtatattagtctgttttcacattgctataaagaactacctgagactgggtaatttagaaagaaaagaggtttaactgactgacagttctgtgtggccgaggaggcttcaggaaacttacattcgtggttaaaagcaaaggagaagcaagcacctccttcacaaggcagcagaagagagagaaccaacaaagggggtagtgagacactttgttttttttttttgagagggagtcttgctctgtcgcccaggctggagtacagtggcacaatctcagctcacttcaacctccgcctcccgggttcaagtgattctcctgcctcagcctactgagtagctggaagtacaggtgtgtgccaccacacccggctaatttttgtatttttagtagagacggggtttcaccatgttgcccaggatggtctccatctcctgaccttgtgatgcacccgcctcggcctcccaaaatgctgggattacaggtgtgagccaccgcgcctggcccagtaagacacttttaaaccatcaagtctcctgagaactcattcattattaggagaacagcatgggggaagcacctccataatccagtcacctcccagcaggtccctcccctgacccatggggattacaattcgagatgagatttggatggggacacggagccaaaccatatcagagagtattgctggaagccactagtacctattgttaaccactttctaccccagctattattagctaggctgtaagacttctcaaacttgagtgtttttcagaagtacttggctagcttattaaaacacagattgtttggcttcatcctcagagattttgattcattagggcctgagtggtgggccccaagggtttgcacttgacatggacccagatgttgcaatgctgggtctgagtctggaatcacatagagaatgttcacatttattaccccaaattctctgtcttgggttgggttagccctgctgttgttgcttctgtttggtctctctcagtgctgatgattgaaagaggcatcacttcacccagtacaatggggtctgatggggagggaggaaacaatgtgagaattcttccccagcctcaactcttagctgctagagctctttctgccatgctggcattctataatctttccaagggttttcacagttttaatttagtaactagaacccatcaaattccttgtttctctgtggcatctcctttaagatagaatccagagtagaaagccaccaacctatgttggttcatcatcttttcagaaatttgaagtctaatgtgacttaaaaaaattcttaaaaaaactgttgaataatatgattttcatatagctatatgccaattactttgataacttcttgtgtttaagattatctttcctaactagctataactatagtaatgtaatgcaagcctatcttgtctaaactcagacaatgtatttcagtgatatgttttcctttatcatctttagaagcttttttttgtcattaatgtcaaattgccaagacaactaccctatgtgggtaaaaaataatgagaccacaccttgctttttttttttttttttttttgagagggagtcttgctctgtccccagactggagtgcagtggcgcgatcttggctcactgcaagctccgcctcctgggttcatgccattctcctgcctcagcctcctgagtagctgggactacaggttcccgccaccacgccccggtaatttttttattttttttttgtatttttagtacagatgggttttcacggtgttagcaggatggtctcgatctcctgacctgtgatctgccctccttggtctctcaagattttttttttaatacaacatcttgaataccttttagattctaatagctgtacaacttagaacacctttgggttttctatcttcacagtgtacttataggaccctatcttgttatttaggttttaaagggactgtattaacagaagaaagatatgtgtctccagagcatgaatgattttgtcaaatccagaacagggtttcaaacactgaaaaatgtcagattattttcaaacactagaaaataaatgatatggaaaaacaatatatgacaatgaggcagataagtgttcatttctggtaatgagggcccctggaccacttatttggtaggttggcctaacatttacatttatgtcaattctttggactataaggaaagcatctcttatggggatgacaatagcaagatacagcgctacaatgaaatctaattgttattcactattgcactggaatgtcaatgaggggatgcattgttcaaaagctggcattggtaaagttattaaattgattggttcatgaaggaatatagtacattagtgagctactcatctgtgaccgagagtatgtattagaaagcgtgccttcataagtttccaacatcataaatcaaggcaagatttagtacacaacactggcaggaagcggcaatcatatattttacaaggctcagctcaagaaagctcaaccttcagtcatatttgggtcagtattttatatttataatttgctccatactattgtcatgtttattatatttggttcttgtacaaggaatttataatatgaatatgattagaactgagcgacaaaaagacaatccctgcagatttctattgagtttcctctatgcttggtaaataaagtgtatttttttgacttttaattatatatgtttaaaaagtgattgtaaccaattttgcattcattcccacgttgcttccataagtaattattctaagttattagatataaatctaaatattgtaaaacaccctaaagctagagtgaaaaagaaggttttttaataagaagaacagatatttttaagcagtaaaattagaattttattttcacatttatactattctagcccgaatatctgcttcttttatcaaatcttatctggtctttcttatctgaatgaatatcacttctctggattttattactttgttttaaatgttttagcactcttaactaatttcacctcatattagagttttacacatatccacttcctctacctattctgtctacctattgacaacaaaaagcatatctggttaattaaaatacttccttttctttcccctaatacacttacagtcatttacgagtttaatatatcttgtgaataaattaatatttatctgatgtcaaatataagaattcataaaacatcaaacaaatgttttggcttaacaataattattacataagtactatattttataaatagtaactaatataagtagtttacacatataatttcggtgctagaattcagtatataattttattagttaccaaactaacatattaaaatctcatattaaaatctcagaagatacttttagtgttataaaataatctaagtaattaataaatgtgtattgtgtatgataaagtttccatgcataagtttacaaatacaagtgcttatatataaattatattattaatgatatatatatgcaaataaattctggaaatacatttacataaaatgtatacacacgaaatcaaccttcttatattcaacaatgctttcccatgcaaacaaatgtaaaaacacctgtaaacattcctatattgtttctctgataaaacattaacatgttagatacagtatgatgtgttaggatgtgcagtagccacgtggattgatagttgggttctagactcagcaacaccaagagccaccactcgtcatttaggaaatagcctaacttctctggtcttttctaagctgccttgtaaaatgagtgtatgaaacttcgatctctaaaatatctatgccaaatagaaaaatctggccctaaatatagtcctaaggctaccatatttttagcagtattaagagctcctggtgtctgtctgtgtatagacattagtgtgaatacaacatgtgttggggaagggtgagatggaaaaaatacacacaagatatactctatcaggaggaggtaaaatttggccagtgtaggtctaggtacacagtagttgatgagcaaacagttaggacatgcctagagttctttaaatttgctagtcagccacagccatgtgaggaggagttgtcattaaacagagaattaaaggatagaagagccaattctgtccattagatatagcctttctggcaaatgaaacaaaaactgcaagtgtgtaaggccaaacagagcttgctattctcttttgaggctttttttttttctggatgttgttaatttgtcctatgtgtctgtaaatcattaggagagaatgtgtcagtacccagtaatccaaaaatcttttgtaaataccattaaaatattaaataatatatgctttaaaatccttcaaaagtttaaaaaaatctaattttattttacataatcaaataatagaatcagagaactgaagggcatctttataaatgtagcccagtggttttcaaattctgcgctatagaaccattaggctcagtttagcaatcccataaggcacttagttaaaattacgttaataaagtctatcttttttattatttttgaagttgtaattttaaatgggaacaacttcaaatgtcctataaaccaaagtattaattaactggataccattaatataacttctgcttcaaatctgactttttgttttctgagtctgaggactatggaatagtttttcttgctctcacatgtgtatgtgtgtgtgtgcgtgtgtgtgtgtacatgaacatgtatgtcatgtgtactaaatgattatttattaaggttgtaactcagtattgttattattctgagcgaaggtctccacgtgcctactcccattaacttataaagatgagtatcctgttacagcatgtgcatgtcatatgtaattgaattttatctaaagttaggacacatatttcttgctatgtgctataattatggtcaataatagattgttcaacaacaagaaaataaaaaatattttcttaatggtaccgtattatgaatgttctaatttttaaaactactgattatttaatgttttgtttgttatttattatactttgattcaaattttgagtttataataaatactgtgattagtgtttgaaattttgaagcaacaattgcttcaaatttttagaatcattttggtgaaaagttatgctacatataaaattgcttaaattattcacagttacttatttgcatgggtcaagacttcttggaattgttcaaccaaaacaaaatgtagaaataaaataattctgccccagaaaaaccaatgagttaaagatgagattaagaagtccttttttttttttttttttgatacagagtctcactctgtagcccaggctggagggcagtggtgctatctcggctcactgcaagctccgcctcccaggttcttgccattctcctgcctcagcctcctgagtagctgggactacaggcgcccgccaccacccccggctaactttttttgtattttttagtagagacagggtttcaccgtgttagccaggatggtcttgatctcctgacctcatgatccacccacctcggcctcccaaagtgctgggattacaggcatgagccacagcgcccggccaagaagggcattttttaaataacttaagacaaatgaaaatggaaacaccacagacaaaaacttatggcatggagcaacagcaattctaatagggaagtttttaagtaagtaaatcaaaaaagaagaaagatcccaaataaacaacctaacattacacctctaggaactggaaaaaaaagaataaaccaatcccagagtcagtagaaggaagaaaataataaagataagagcagtaataaatgaaatggagactagaaagacaaaggaaaagaacaatgaaactaagtgtttgttgtctgaaaagataaaccaagttgatatacctttagccagactaagaaaaaaatatagagagagaaaggactgaaataaataaaattataagtgagaaaggagatactacagctgaaaccacagaaatacaaatagctatgagagactactgtgaacaaatacatgccaacaaatttgattacccagaagaaatagatatatttctggaaatgtataaactacaaagatcaaatcatgaagaaatagaaaatctgaacaaacccatagcaaggaggttgaataaataataatcaaatgtccatcaaagaaaagccccgaaacaaatggctttgttacaggaatagggttccaatccagacctcaagagaggattcttggaccttgcataagaaagaattaagaaagtaaaggaataacagaatggctaatccatagacagagaagccccgagggctgctggttgcccatttttatggttatttcttgatgtatgctaaacaaagggtggattattatgcctcccctttttagaccatatagggtaacttcctgatgtggccatgcttgtgggagtgtagcagtgaggaccaccagaggtcactcttgtcaccattttggttttggccggctcctttactgcaacctgttttatcagcaaggtcttcatggcctgtattttgtgctgacctttcctatctcatcctgtgactgagaatgccttaaccgtccgataatgcagcccagtgggtttcagcctcattttacccagttctgctgaagaaggagttgctctggttcacaggcctctgacagcttcacagccgaattctaccaaacatttaaaaagaaactaatactaatcctcctcaaacacttccaaaatattgaagaagagtgaccattttcaaactaattttacaaggctagcattagcctcctatcgaaactaaataaggactctatgagaaaataatatttcaggccaataaccctgataaacataggtgcaaacgtcctcagcaaaatatagcaaaccaagtttaacagcacattgaagcaattattcaccatgatcaagtgagatttatgcttgggacggaaagatggttcaacacacaaaaatctatgaatttgatacattgtgttaatagaatgaaggactaagctatatgatcatttcaatagacacagaaaaagcatttgacaacatttaatattttatcatattaaaaaactctcaacaaattaggtatgaaaagaatgtacctcaacatgataaaggccatatatgataagcccacagctaacatcatcaaactaaatggtaaaaagttgaatgcatccctctaaaatcaggaaaagacaaggatgcccactctcaccacttttattcaacatagtactggatgtcttagctagagtaataagacaagaaaaagaacaaaaaacattcaaaaaggaaaataaagagtaaaattgtctcaatctgctgatggcatattcctatgcataaaaaaccctaaagaaaccaccacaaaaccgtcagaactagtaaattcagtaaagttgcagtatacaaaagcaacatgtaaaaatcagtaacattcctttatactaacaacaaactacctgaaaaccaaattaagaaatctatcccatttacagtagaataaagaataaatttaaaaaaaaaacatgtaggagtaaatttaactgaagtgaaaaatatgtgtattgaaacttttaaaacattgatgaaaaacattgaagaagagacaaataaatggaaagatatcccatgttcatggattgaaaaagtttatatattttaaatatccatcctacccaaagtgatctacacattcaatgcagtctgtatgaaaatcaaaatgtcatttttcatggaaagaaaaaagtgtcctaaaatttatttgaaaccataaaagaccccaaatggtaaaagcaattgtaagcaaaaagaagaatcctggaggtatcatgctacctgactttaatacctattgcaaatttatagtaattgaaacagaataatactggcataaaaacagacacattgacaaatggaacagtatggagagcccagaaattaacctgtgcatttatggtctattgatttttggcaaagataacaagaatatgcaatggagaaaagacagtctcttcaataactggtgtttggaaagctggagatgaaaatgaagttagacccttttctcacaccatataaaaaatatcaactcaaaatgaactaaagacttacatgtaagacctaaaactctaaaactattcaaaaaaaaaaaaaaagagaaaactgcatgatattgatctgagcaaaggtttcttggatattagcaaaaaaacacaggcaacaaaataaacaaataagaatacgtgaaaataaaaagcttctgcatggcaaaggaaataatagagtgaaaaaacaacccaggaattgggagaaaatatttgcaaaccacacatctaataaggggctaatatcctaaatatttaaggagctcaaacaactcaataacaagaaaataaataacccattgaaaaatgggcaagggatctgaacagacattttccaagagaagacatatatattttgtaatatatattttgtaatatattttgtaatatattacaaaattctcaacatctctaattagcagggaaatgcaaatcaaaaccgcaatgagatatcacctcacatctgttagaatggctattatcaaagtgacaacagataagtgttgaagaggaaatggaagaaggggaaactttgttgttggtggaaatgtaaactaatacaatcattatttaaaactctatggaagttcctcaataaactaaaaatagagccaccatatgatccagccatttcacctctggatatagttccaaaggaatggaaatcagtatgttgaagaaatgcctacacttaagtgttcattggtgccttgttcacaatagtcaagatgtggaacagacctaagtgtacatcgaagaatgaatggataaagaaaatgtagtgtacatatatcaattaaaaatgtagtgtacatatatccttaaaaaagaaggaaattctgctatttgcatcaatgcagatgaacctggagaagattatattatgtgaaataagcctggcacaggaagacaaatatcacataatgtcccttacatatgcaatctaaaatgtcaaactcatacaggtagagagaatggtggttaccaaagaccggagaaggattgggaaaggggagatgtagatcaaagggtatgttaaaagaaaaacttcagccgaattaaatttaatggggtttaattgagcaatgaacagtttgcaagctgggcagcccccagaatcacagcagattcagagagactccaggggtgcctcatggtcagaacaaatttatagacaaaaaaaagagacatgacctacagaaatcagaagtgaggcacagaaacagctggattggttacagattagtgtttgccttatttgaacacagtttgaacactcagcagtgtatgagtggttgaagtatggctgatgggattggccaagacgcagtattgttacaggaacatactcttgagttaggttttcaatcttgtctacctattaagttaggtcatggttcagccacaaggactcaaatatagacgtaccgagtccttctcaggccatatttagctcactttaacgggtacaaagtttcagctgggcaggaggactgctttttagtgatctactgcacagaatggtgaatagaattaatgcattgcatcttttaaaattgcttaaagattagattttaaacgttttcaccaaaaaagttgataagcatgtgaggtgatggatatgttaattagcttgatttaatcattctataatgtaagcatatattgacacatcatattgtacccccaaaatatttacaattattatttgtaaatttaaaaaattaaattgttttgatggtatattattgatggtgtcatacattacttttgactttaaatattggtatattagaatagcctcactgtttaattgaatgtttttataataagccagtataatagatttgatattatgagatgaatttgaagttatacatgatttttctgttttacaaatttgtgttatatacaaggtaggctttttacattttccagggttaaaaaaagggggtaactcattgatgtagatcactctattatttctcccaagcttgttagaggtacagcaaatgattttcagatggagaatgagattctctcagacttttacaagctagttgttttgattggttgtttgtttgtttggtggtttttttggtttgtttttgtttttgtttttctctgagatggagtcttgctctgtcacccgggctggagtacagtggcccgatctcagctcactgcaacctccacctcccggttcaagcaattctcctgcctctaaaacacagttttattgtgataaatttacattttatgtaatgaccaatttaaagtgtacaattcactagttttaagtatattcacaatcactagtctgtctgagtccatagatttgcctattctagacatttcctctgagtagaatcttacagtatgtggccttttgtgtctggtttctttcagttagcatatatttccaggttcatccatgtagcatgtgtcaatactctggtctttttgttttcaaagaatatttcatggtaaggatatcacacattttgtttactcattcatcagctgatgaacattttgagttgtttcttctttttgcctattatgaataataacactgtaaacatttatgtataaattgtatttgaacataggatttcatttcttttaaatatatacctaggagtggaatcactgggtttaagagtgactctattgtttaacatgttaaggaaccgccaaactgttttttaaactggataccacactgccaacagcaatggatgagcattccatgttctccacattttcatcagcacttgctattctctctctttttcaatgtaactgttctgtgggatatgcagttgaatgctattatggttttggttcgcagttttctaattactagtaatgtcaaatagcttttcatgtgcttattggccattcatttatctttgttgtagaaacatccattcagatcctttgcctagtttttaattgggctatttatttttttattatcaagttgtgagacaccagcagtgtttgaggattctacaaactagtttaaacctgtggtcatcattcttgcataacatacataactccatttttaattaggaaaaaaaattaaccaggtttctgtagctaagcaatgttcatcttatatgtgaatacccagtcagataatataacttactgatactactatttgaagatttaaaaatacataatttcatctcctaccaaacccatttgctagctgatattttagtgcctttccaaaggcatgacaattattttcctatgaactttcattttgaagaaggaagttgaaaacaaagagatgttactatggctctcattaccaaagtctacttccaaaagaaaatgatagaggaatatgaatttagaaaatatctcctatgtctctggttgtacagagtgtatgtgcgtatatatatatatatatatacttttgttggatggaatatgaccagtgatctgtggaaataactgctggaaaaccaaaaaattgggatactatttgcaaagttaatatttttacacctgttaattttactcatttaagaaagtataaataattttatcatgcgttcatttccggtgcctggaacatgaaaaaactaaaatataattttaagtttttcgcttactcaggtaaaacctcattatctaacctcaagaccactgaaatgaaaatccagttgtaatcataataacactcgcacagtggtgataggttatatccatacagtttctgctccagtgaaattccattttaagaaaatactctatgctattcagtcgctggacattcattgtaataagatgtcatttgtataagcaatatgaattgcattcttctgtcaagtggacataagttcaagtatgggtgactttgagaaagattctatacatggtagctgaccaatttgttttggtggctatatagcttaaatataacaatggttgatattctatgaaaaatagacaacaaaaaaatctaattgtcattgtttaaatttaaacagataatgtcaaaactccagaaaatatgtgacatctgctaagtaataattctctacatctctatacgcctttttttttttttttttttttttttttttttttttttggcagagtttcgcttttgttgcccaggctggagtgcaatggcgtgatctcagctcaccgcaacctccacctcccgggttcaagcagcaattcttttgcctcagcctcccaggtagctgggattacaggcatgcaccaccatgctcagctaattttgtatttttagtagagacgaggtttctccatgttggtcaggctggtctcgaactcccgacctcaggtgatctgcccacctcggcctctcaaagtgctgagattaaaggcatgagccactgcgcctggccctgtatgtgcttttttataacattatcttatgaaatgtaattggagcattcatcacattgtaattgtacctttgtgtgtgtttgtgtttgaatgcgtgtgtgtgtgtgtgtgtgtgtgcgcgcgcacatttcagagaaacctgagaaataattgtatggaaataattaaaggtatcttatgaaatgtaattggaacttttatcacattgtgattgtacctttgtgtttgtgtttgagagtgtttgtgtgtgtatgtgtgcatttcagagaaatctgagaaataactaagggtatggaatgtatgctttatcttcattttgccagtacctagtacaatgtctgacatataaaagtactcaggaggccgaggtgggcggatcacctgaggtcaggagttcgagaccagtctggccaacatggtgaaaccctgtctggactaaaaatacaaaaattagccgggcatgatggcgagcacctgtaatcccagctactagggaggctgaggcaggagaattgtttgaacccgggaagcaaaggttgccgttagctgagagcacgccactgaactccagcctgggcaacagagttagactccatctcaaaaaataataataataaaaaataaaaggtactcagttccaattcattaattaattactatagttgctgctgttagattggctgctactgctgctgctacaaatactatctctgctattgctcactattatttattgagggctcattatgtgctatactctttttacttcttctcacttcatcatcgtaagtatgtggtactcttgtattgctttatcactgaaaaaaatagggtcacacaaaaaaataaagctggggagaggttaaaattattttatcaaggtgagtattttggtctgctttgtttttttacatttgtttccttgtgtgttttgcatatataatttcctcagaaaatgtgacggtaaaagaaactaggatccaacatatgtttccaaataggtcatagtgaatgggatcagacatgtgaaaattcattcaatctctcatgggcatcgggcaagggaaagggacatggggttgtacatgtgatatctttagttcaaccacctaggaggaaaaagtgtgctttttttcttgttttatttgcctctctgccacaaacccatgtttcaaagcttgttcaaaatgaatactcaataaatattattgataggcagcctacctgccacacatcatctttgataagtgaattataatgacaatactttgggttacgatgtctgccctttgagagaaagagaatttaaagtaaccacggcctatctcagcttgctggagatataaatctcttggcacctattagcataatctacttatggaagagacataaatgtggagcgaaagggttgcaaaatgatttgttgggtactattgttgagccctaatttaaatcacttggttttctccattattattccaaagcctcatctgaatccttctgacattgaatgtactttataggaacagtatattcctataacttgtaaaatctttaatgtaagatttatattatcttcagtaagatggatgagaataattactttaagtcttgttaagttcctcaaccaatgctgttacaaatttgtacaacagaaagaattaaaatgtcacaagatatatttctgagcataacaatcacagcatttaaaaatattcttaagcatagtatttttaaacaaaattcatggattatctttgcatatacttatacacgaggacagtatggttttcttgaaaacattagttacaaccagctttcaggttcatttttaagtatgggccatattgctgtatgtgaaagctgacgtttcaccagagccacagggacgttaaagtttaaaacagcaaatgtaaaatcatgccactggtcatttgataaacttgaaaagagaggacacaaatgtcagtatctgtcaaagtaaacacaattcatttttttattcatagcagggaaagtcatatgtcaaaggaaaaaaagcgtaatttgctgtgagaagaatgccaaggaaaaggacaaaataacatcgattcggtagttagactgaatatacaagaagtaaggaaaaatgtgtattaacacatatatatcagagatgtaaaatttatatgaggtaccaaaacatcatgttatagattcccttctctacataaccaggctgatgctctgtgccaatgtaaataggcccaattattaccgtttctagtgcagcagaaagcaaagagattcacagaaaatactgccttaggctgtcaccatggtggtctcagcaggggctgagctaagcttgagtctacaggactgacccaaggcttgaagaaaccaatgagggtaagacttcacacagagggtcgtgtcgcaagggatttgctaaagatcaaatcctggtgaccaagaaaagcccaatagctagataagaagtgaagtctttgaagcacacctagcagaacagaactagaagaggagttttccaaggtaaaactctgcaaatattctttgaagcaaagatacagagaagatgaaagattttataaaagcatttttggctccttccatggggatagaaggagttctttatggttgaagaagtaagtaggagacaggactaataatactaagaacccacccatagacctttcactaagttactcgatttccattgccttcaagtaatatatttgattgccttatttgtaaatgtgatagctaacttgtcttccttacagaacacctgtgaagattaaatgtgactatgaacataaaagcactctacaaaattaaaatgtatttacaaatggggaattattattctgttaattttcttttattttccttcctttcttcttttcttacattcaacaaatatttcatgagcatctagcatgtaccagacattcaatgccctaagtgaacagtcaaatcttcttcctctagggagctcacattcaaactggagaaacgtaaaacgaaatgctgcagtagatgggactagtgctacagaggacagtaaataagaaaaaaagaactggagcaatgataagaagtgtgggggtattgaaattttgacagagtatccatggaagtcttccccgagaaagtgacattttatgcaagactaggagacatgaaagaatgaatcatgcagatttctaggagaagactatccaagcagagggaagagcaatcgcaaaggccatgaggtggaagaatgttaacatatctcagaatctccaaggggagctatatggttggagcagatagagggaagtaagtaggatatcagtttagaaaggcaatggagcagcagatcacatggaacctttagggtcatggtgaaggttttggcttttcctctcagtgtgggagaaacaggacatagctaggcaactcagtttgttacattgagaatagacagaagagaaccgatggttaaaactgggctcctgttaagaaatatactgaaagaattcagttgtgaaatgatttaatgtggaaaagagtggtagcagtggaactgttgagaaatgttaagatttttggatataagaataaggtagactcaacaggttagctggagtcttgggtgaaggttgttaacaaagagactaagtagtctgagcaaacagggggctagagttgacattaactgagatgggaaaactggagagaagaaattctagggaggaggaagtggtaagagttcagtttgggactttctttctttctttctttcttttttttggacggatttttgctctcgttgcccaggctgtagtacaatgcatgatctcggctcactgcaacctctgcctcccgggttcaagtgattctcctgcctccgcctcctgagtagctgggattacaggcgtgtgccaccatgcctggctgattttggtattattagtagggacggggtttcaccatgttggccaggatggtctcaaactcctgacctcaggtgatccacccaccttggcctcccaaagagctggattacaagcctgatccaccgtgcctggccagtttgggacattttaacttagtagaggcatattaaacatccaagtggagatatcaaggagacttttgatataaatctgaagattaggagagtagatttggttgaattcataaatgtaggcattgttagagtagaggtgaggtggtctgtaaatctaggtgattggttaagaccttcaagggagtaagtatggacagagtagagatctacaaattacctgagaggcatacctatgtttccacgtcagaaagataaagaggaggccgggcgcggtggctcacgcctgtaatcccagcactttgggaggccgaggtgggcggatcacgaggtcaggagatcgagaccacggtgaaaccctgtctctactgaaaatacaaaaaattagccggggacaatggcgagcacctgtagtcccagctactcaggaggctgaggcaggagaatggcatgaacccgggaggcagggcttgcggtgagccgagatcgccccactgcactccagcttgggcgcagagcgagactccttctcaaaaaaaaaaaaaaaaaaaaaaagaaaaaaaaagaaaaagaaagataaagaggaacaagcaaagaaaaccaacatgggacaatcaaataattaggacagttaggacagtgtggtaatttgaaaaccagatacagaagatatcccggggacagggagcaatgcactgtcaaatgcttatgattcagttgtatgattcactgcaacctccacctcctgggtagatggttgaatgaggatgaccacttaccacctgctatggtttggtttgttcttgcccaaactcacgttaaaatttgatcccaaatgtggcagtcttgggaggtggggcctagagggaggtgtttcagtcatgggggcagatcctttatgaggacagagtaatgccctcctgcagggttacttttttgcactccagtgaaggggttagttcctgagagtagcttgtttcaaagactctggcttcctcagtttctccctcttgtttcctctctcaccatgtaatctctgcacacacctgctccccttcctctttctccaatatgttgaagcatctggaggccctcaccagatgcaacaggctgatcttgaactttccatccattagattcatgaaccaaataaacatcttttcttcacagacagcccagtctcaggtattctgttacagcaacacacatggactaagacagcaccacacacaacaatgcaaaagccatttatgatcttgaccagaggaatttcacctcaaaggtggaggcaaaatcatgataaagttagtttaagaatacaagagaaggctgggtgcagtggctcatgcctgtaatcccagcactttgggaggccatggcaggtgggtcacttgaggtcaggagtttgataccagcctgatcaacatggtgaaaccctgcctctacttaaaatacaaaaattagctgggtgtagtggctcatgcctgtaatcccagctacttgggaggctgaggcaggagaatcgcttgaactcgggaggcggaggttgcagtgatccatgaccacaccattgtacaccagtctgggcaaccacagcaaaactcggtcccaaaaaaacaaaacaaacaaacaaaaaaagagacaagagagaaagtggagacagcagggtcagtaatattttcaatgagttttgctaccaagagaagcaaaattaataataataataggggatataaagttgagccaacattcttattttaataaaaaaaatcttccattaggcagcattcagaacagaggaaaacaattgataattattggaacagtgctatggagcaagtgagaaggcatggatctggtgtccaagtgagttgtcctgagatatgtttgggaactctgctctgtggaagcaggaaggccagcagagtttgtggacacagatggatttttgggtgaatgtggtgcagagagcccgcagaggctttcttctgagtggtctggattctcagtgaaatttgaagctaagaggaagactggcatagagggttgggcttaggcagaagtggtatatcaagataagtgcatggaattggggaatgggggacaaggcagggaaagtatatgtgaggaaattactatgaatgatcatgtaagcaaggtaaaaaggaaaatgagaaatgaatggtgcagggtgaaagtgaagaatagtgaaaggctggaaggtttataaatcccagggaggtatgttttcaaagctgcttattggtcgtgagacccaaaagtcttggtcattccgtctgctaaaaagtcttcagtttctttgtatccttatcgcctctgccttatttaacattatcattatcattatcattatcattattattattcccagggcattttccttgcctcttctagagtgctaaccaaaatatcacagaacagcatcatgagcatcacttgggggcttattagaaatgcaaattctcaggcctcgacttaggcttatcgaataaaaatctctaggactggggctcaggtgattcttctgcatatcaagtgtaaaaatctctgctcttactgcatataacatacaaaaatctctgtccatacagccacccaagggattttccacataagcaaacctcattatgttctacttttcctcaaaaaaatttgagcctgctttacctaaagcataacatctaaaaatgtgtgcttagctcattcccatatttacacctgtgctctcgtcttgttgataatatcttcatgtcttagcctctgctgttgttggctctgaaaggtattccttatcttgctatacaggcagaaaaaaatttattcagttttcacatttaagctgagacctgttctcattcctcttggtcagctcagatgcttttaccctatgctttcaccaaactttatatagacttcaattttaataggcatatcattatattattaatttttacatgtattgccctccactaaacagaaagctccttgatggtaagtatatttttcttttatctttgatgtccagcatctcaatcagttattaggcagtcactatatgttcttggaagatgaataagatattccaaagtaaagtggtttctgcatttagatgctctgccatgtctgaatgtgacttacaataatttattatatgttatacacatccagaaataatgaacaatctgtttataaagtctatttccttacaccaggtcatttatgaatatgttaaataacaagatacttataatactttcatttttcatatggtaaagccaaacgtttactaatttttcagcaagactttgtgatttgagtgaattatttttcttgaactataaaggatttttccaaccattcagattctttccccagagtacccttgcagtacctgacaatatttgcctattactttgtcaaggcaatgtgagtgtttctgtggttttgcaacaaggtttgccaatttgaacaatgattgaagtcatgataatgacctcatcaatttcacattctagactgagccaaccaattccgttcagatttgttatgcatttcatttcatggggccatactaagcaaacactttcctgttaatctttgacaggtgggccaactgacacatttaaacaaatgaagtctttttatttattgttggtagattaatagaatcatctgataggtaaaaccccaaaaattttggtgtagtttcaacacttctggctgatgtcatatacttgtcacacaataatgcagactcatattactcttgaattattacagtaaatgtgtgacgtggtataaaaaacagaactacataatactctaaagtattaaaggcatatgaaattttggggaagactacttgttttggaagagcattactaagtttacaaaggaatttacatagcttcctttagtattttgacaatataaggtcattgtttaaattttgtttttctaaattatacagagattatatcaggaaatatatatatgtgtgtttgtgtatggtgtgtattcacacacactcatacacactaaattaaaggaatgagtcaagaattcttttacaaaattataaaccccttggattgatacttccaaggataatctgcttgacttcttgaaattcttgacatctgtattctgtcttccttggcacatgctagactgccctttccagcattcctgtagctatgtgtgatgatgtgactgagttctggtgaatgcaatgtgaatggaaatgatatgtggttcttccaggcaagaaccaaccaaccaaacaaacaaacgaaaaaaacactagccgacttttcctgtcattgggctgaatgaacaagagtccagggatctaaaggatgcacctggctccaaactgtttcaatagagaagaaagccccccacctccagtccccactaaccctcattaaattacgatctaatcaagatatttgcattgttttaaaccactcggattttaggattcatctgttatagatgctattattatttgccttaattatcatcactggaatctactctcaatagccaacagtcagtcttatcccaccctttatcctaccctaggtatggttgaatgtctaggttctgcttggcaaagatgatttagacaataaaggagaaaaactggaaacttggacagcgatcaaggcagaggatggccaagcttagcctggagcatgcacaagttttcaacataattgcaggcttagttatggccttaggatgaaataagtggaaagctaaaatggagaaataaattaagacaaaaatctagatatgacttaggtaaaggtgaagtctgtgacaatgatgagaacttgctccagaggttttatagcacataggtttactggtcaaagcgatattttagcagctctgattctatgtagctgattcatattttaaaagccccaccttataagagtaaaaactattttctgtattggtagtatttttatttatcgaactcttccaatatgtatttgatgaaaatgataggttgtttgccacattgaggagaaatagggacacatcatatgcaggccagatagtggctaatctcctaataattatcagattgtctctggacaagggatcaagtttatctgaactttacctacaaccatgccagctaagcagaactactcatggattttcagttttttcatttaaatttgtatattaatatgtgatcctaagtaatgatgtatctaaagcatctttgtttactttacactaaataaattaggatttaacaatacagttgtacaatttgtttttttgtccaaccccaagattattgatctccaggaactgaatccccaatgctcaagtgattcaacactttaagacaggcaagtaatggatgactgagttaaacacaaggtagagagcacatggaatatgcatctaactggtttaattaagttagttccatctaactaacttccagactaggaagctgaggagcagcaacaagaaggctctgtttagagggtcattagtaaggaatagacaactcaattaggtaatccagggagatacattttgtaacatgtgttttataaacataactcagctcaatacatacccgattgaaataaaagagtaaaatgtgagcacctcttgtgtgtcagttgtgacgcctcatgttttactagtgttatcacatttagagcttagggcggtcttgcaaaattgacaagcaatttgagagataagaaaactaattcaaattttgaggtcacatttggatactatgatttatggcttgctagtcactttcacaaagtgattttttacagccataatttaactttctatttttttaaatcgatttacctcttgtcttggcaaataggtaaactggattataattacatggtaccatcataggttccccagaaaagggtttttttaatcctctcaaaatcaccaccacttgctcacttatattttgaatctgttttagaaaacataaaactttctttctattattagagctctagctttatatgtaaaaacacctttggaagaactggcacattaaaattgtttcacacagagatgtaaatgggtgccaatcttcattaagtttgctgtgacataaacaaaattatactttttctatatcatgactaaaaagtaaaagagcgaaagtagactaacaaaatggagagaaagatgccataagatttcgcaagaaacacaggaaaaggggggcaagggatattaaaccaaaatatgagattaattcccactttttctaaggcacaacttcagatgtttaatttttcattactaaagaagataacgatcaacctttaaaaataattgtttttccatattatctttatatctgttttttatagtgagacattcatgttttgttcattcacttccatgatgcacaccttgcactgataaaatgaccaaggcacccccaggactcatcatggatggtgacgaaaatcaagcctgaaaacttggattcagtgtgtcatcctttatagtagcacaatttagaaacaagttagactattatgaataagttgtttctccacagattattttctgttttgttaaaaccccatttagaatgagattgattgaatggtaatcacaactattctagttgccaatcactctttgggcttcactttttgttattgtcctagagggtcagcagctgtgaacttgttctcattaattttcctgacaagcgctagtttacatagaaatggttgagtccaaactcaggaccaatttgaattcatttgaagttagggaaacaactgattagggcagacctctaaattcaacagatgttacattcagttttgcaaactgatggagattgaagatccgtggcctcagtggtttataattgcactctagcacacaattgattattgtatattatttgtcatttatatggtatgaaagcctggagcctttgactcatagatgaatgtgtcagtgaagatgctttaggtatcctactcaacccacccttatacacaaaaagacttatttacctagcaggaatctagaaacagggtggatctcaggatgatggatccattgattccatgccattgaggactgcaacacatatttccccacagtgccagtttcatcctgtattgactctcatggtgaagaatggttactatcagcaattggacctacatgtttctttgtatatatctaaaagctgagaaagaaggtttctcttcagtattctaatcaagaaagtgttctatgatttagcttgattggattgtctaagtcacatgtcaatagttaatagtgactgcgactggggaaatataatgtgctggttatattgcactaatgcacataagctccataacagaagaatagacgcattgcagttcttttggaaggacgaaggggtcaatatttgctaatcacacaaccaaaaatatcaacgatagcctctgtccagcatccagaacacagtcaggctttgttcttcatttcatttttgcattgcattttgtaattttgtttatttatttttatttttgcagttaatgaatagtaatatagtcatataccatgtaatcatgttttggtcaacaacaaatttcatgtatgacagtggttgcataagattataatggaactgaagaattcctattgcctagtgacatcacagctgtcttaatgtcatagcacaatgaatttctcgtgtgagtgatgatgatgctgtaaacgatcctgctgtgctgccagtcatataaaagtataccacatgcaattatatatagaacataatccttgataataatgttactcgtttatatatttaccatactagatttcttatggctattttagtgtgtactcctacttattaaaaaaaagttaactgtaggccgggcacggtggttcacgcctgtgatcccagcactttgggaggacgaggcgggtggatcacgaggtcaggagatcgagaccatcctggctaacacggtgaaaccccgtctctactaaaaatacaaaaaaattagccgggcgtggtggcgggtgcctgtagtcccagctactcgggagactgagacaggagaatggcatgaacccgggaggtggagcttgcagtgagccgagatcgagccactgcactccagcctgggcaacggagtgagactccgtctcaaaaaaaaaaaaaaaaaaaaaagttaactgtaaaacagcctcaggcaggtctcttaggaggtatttcagcaggtattgttatcataggagatgacagctccatgcacgttactgctgctgaagactttccagtgggacaagatgtggcagcagaagaccgtgatgttgatgatcctgaccctacggaggcctaggctaatgtgtgtgtttttgtcttaatttttaacaaaagctttaaaaagaaaaaaactaaaataaataaacttaaacatagaaaaaagcttagagaataaggatatgattaaataagatatttttgtacagctgtgccatgtgttttaaattaagtgttattacagaagaatcagaaagttaaaaaatttagtttataaagtaaaaaactgcagtaagctaaggtaaatttactaccgaaatttttaaaaatgaatttaataaagcctaggtgtgcagtgtttgtaaagcttacagcagtgaacagtaatgtcctaggccctctcgttcactcacaacttactaagtcctgcaagctccattcatgataagtgcaccattgtttgccttttacagtacttttagtgtactttttctatgtttaggtatgtttagatacacaaataccattgtgttacaattgcctgcattattcagtagagtaacatgctgttcaggtttgtagcctaggggcaataggttattccatgtagtcttgggatataggctaaatcctttttatccttttttttttttttttttgaagcagagtctcactctgtcacccaggctggagtgcagtggcaagatttctgcacactgcaacctccccttactgggttcaagcgattttcctgcctcagcctcccgagtagctgggattagccaccatgcccagctaaattttgtatttttagtagagatggggtttccctatgttggccagggtgatcttgaactcctgccctcaagtggtccacccccttagcctccaaagtgctgggattacaggcgtgagccactgcacccagccgggatataagctagatcctatatagaaggtagtggtctatacaccttcaaggtttgtgtaagtaggccctatgatgtttgcaggaaaacaaaaatcacctaacaaggtatttctcagaatgtgttctcctcattaagtgatgcataactgtaaaatgatagtaagaaatatacatatataataatatataaaaaatctgtcgtatccataaaaattaaatggaatgttttgagaggcttgacacaattaagtggttaaaaactcttgtagaattcatgttaaagaaaaaaatataaaactgacaggtgagatagaaaaatatctagaaggatttgcttttttttttttttgagatggaggttcgctcttgttgccccagctagagtgcaatggcgcgatctcagctcactgcagcctccatctcagcctcctgggttcaagcgattctcctgcctcagccacccaagtagctggggcgacaggcgcatgccaccacgcccagctaatttttgtatttttagtagagatggggtttcatcatgttggccaaggtggtctcaatctcttgacctcatgatccactcaccttggcctcccaaagtgctgggattacaggcgtgagccaccgtgcctggctgaaggatttgcaatcacattattttgcaaacattttaaatgttttaatgttttactcttcttttaaaaaaatgaaattagagaccatagaaaatatattgtggcatgattatactgaaaggaaaaatttgaacttcaactaggggctatgcactcaaagaagaaacatttctcctgcatcaaataactagtgaatggtgtctagtaaaaatgcgtttgtgctaatacaaaaatgttaagatgtgcttattatttctatcttaacttagcatttttaaaatcagtgaacaattgctttatttatttattcatttatttatttatttgtgatggagtctcactctgtcacacaggctggagtgcagtggtgcaatctcagtgcgctgcaacttcgacctcctgggttcaagcaattctcctgcctcagcctcctgtgtagctgggattataggcatacaccaccacgaccagctaatttttgtatttttagtagagatggggtttcaccatgttggccaggctggtctcaaactcctgacctcaagtggtccacccaccttggcctcccaaaatactgggattacagatgtgagccactgtacccagccaatcaattgctttaaataagaggacatttaattttaagttagaagtttaaaataaatttaaaataaaccaaataagttttacttgatttaatgaaagtgaaataatttgaagtagaattctgaactttgcataaatgtttattatatgaattttttaaatgctcaacaatgtttacaaattaaaaatcattaaaatgttgtaatcaatttaaactacatatttcatttttacagcattagttgattctttgctgtgaaatacatgattagaacttttttcccctccctaattttttcttctaccttccctctgattttgttgctttattcagcatttatataccattctatagctataatttttctattattttgtctgttatatttaaatagattcaatgcatactgcaacttctaccatggtatctccatttcgtagttattttaatgtatttcttggctgaatttatcattgggcaggtaattttttcccaagaaaaatgtgagtgcaatattcctcgaaggcttttcttgttcacatttgaaaatgtctgcctgttgcctttttcctcaaatgataatgtaactggaaataacacagaattgttgaatcatactttcctttttaaactgtggatagttttacattgttttctagcatagaatatttcagtggagaagtttgaaaacagcatactttttcccccttgtaagtaacttctctgcaaaaaagtatttcttcatccttgaagttcaataaaagatgaattaggatggatatgcatgctggtggttcagtgataaattctcctagtattttatttattgtgcctatttagtttgcaggttcaatgatctctcatttcaggagttttttcctatgttactttcctcattactattttccattccatttgttggattttctacttggagagcatcaattatctttaccttcaatcttctttgtccatcttccatatctatcatcttctaattgctttgttctctcggtctttttcttcacattcactctgattaattccatctatgccagcagcttgatagtcaagaatcctactttgtttattttggctttcattcatttattatattaatatctgtagcaaaattgttttgatattcagtttgctttgataatttttattctgctacttattaacatttttctcttttattgaattcatgtttatattaaatatgtttacatcttgtgcaattgtctctgttgttttatattttgtgtgttgtgatcctctcaacacacaccctacccttgaccaaacacgcttgcaaagttatatgccatttttaaaatctcattcatcattaatttgggcagctctgtctacaccttctatttactttgttataatgtaagtgaatgaattcttcacactttcaccatcttatctagtacctttgcttttcctttgaaattattatttgaacggtggatactaaaaataatctacttttttatacctgaagtcatgaagacagctttatcttggataaagctgagaccattccttgttggagcacatagctccattctcttcttcgaaactgaatgttttgtactagagccagctctcctagacaggtaggggttctgcaagtcagcaacctcccacacctgtcccccacctcaagaaagcaatcactctgagtttttctacctctgccaaagtcctacattgctgtgtaaaatcctccaatctcaagagctattttcattctaaaaattttccctggtttacttctagtattcttaatatatttctctccaaactggagaaatattattaaggttatcagctaactcctcttctttcctcgatactgttgtacccaattccagaattttcttttttcttttttttttttgattgccactttttgatgtttatatttatttgctgatggtgaatcttatcaaattttttaactggttttgtgcttttttggtttgcaaatttgggagggagattttgcaatactgcctccctctgacatcttaatgcaaaatcatctgatctctaaaattctaccagacatgacaaaaatgaagtaaaagaaaagaagtacaagtgagtgagggtattagcagtttttcagtaattaaaagtagcatgatgaatttagcagtttggatcgctgtcctgacattggcaacgttaatcagtaaagtttctacgatgacggaaatgttctatatatttcctgtccaatatggttaccactagccaaatatggctattgagcacttgaagtgtgactggtgtgagtgaagaaccaatatattctattatattttaagtaatttgaattaaaataaaagaattcagtaggtctcattcagtaggtcggggaaatgaccaatgacctgatactgcctatccagggtaccacactttgaaaagctctcctctatataaccaacgtttctgtacagattaaaatcacactgttgataaaattgtgcaatcacagggaaagtagtagttggtgcaatatacttgtctataacaacatagggattctcaagaatctcaggacataatctccagtaacagacaagacactactctttgttctttcctcacagaaaataaccaccttgtctctttcccattcctttcaattgttacctggtgtcttgtgataataatagaatcacaaacttccaagtcctggtttcagctgtagaagaccctttaaataggagttgggttcattcccaaataaaaaatgacactaatattttaatataggtatatatccaaatgatttcttcatgacattggtagataattttataactcactaaaggcaaatactttaatgaagaggaatgttttatgtcatgcatgcttgttaccatcaacaatataagaattatagttatttccttctgtaattcctatccctaacacactgttgacattttccatgctggaccgtataattcagtatggctcctctcacacaaattaggacattttgtcatgttcaaatacagagaaagacatagcctagcatttcctagagaagaaaaattgtcagcattttcttccactgagcaatctcaccatatagtttcattgatctaacagctgatcatattttctaaatcagttgaattttggaaccattttcagtagtgttttacagagacattttctctagcttgaatatttaaaatggtaaatattgttatctgactttattaaaaatgttaatcaggctcattggggaaagagaatcaagataatcagaacagctattctattttttaaaaaaatttaattaaaataaatttaaaaattcttctaaaatcttaaaatttttaaaattatatgacagatcccatcagttctttccatcagttttgatgtttcctatcattttgttactgttttaacaaatatgtaataaaaatcatgatgtttattattattgtttgagtctattgtttggtaggctttctctattcttgctatagatttgtactcagttatcttaaatttttgtcactagttgagtgaagatatttgatatttagtgggaattactaaacaatctgtcacgtttgataatgtgtaaatatgttggacatataatcttatattttgaaaacttgttattgcaaaagctatactttaatcttgaaagcaaatcaccaagtgagatttactcagggttcattttacatttttgtagcattcatggatgaactactttgaagattaaattataagcaataaaaattaatttactacaatagtaaatataccagtaaattagtaggaaataatcacttaaaacttatacaatacaattttaattatgtagagtccatgtttagatatattttctttatgatatacatgggccacaatcaagcatattaattttctgcctgctggcgcaaaagtcggttggtatcttcctaagaaaattttgtcagtttctatagtcttttgcaatcgtgtatattctaagacttgtttggttttgagtgttaagtctctattaatcaagtataatgaggataatctctcttacattattttaaacaagtaattttatttccctaccttccatcatttttctttgttttagctttatcaatgtataactgacaaataaaacttgtttacaagcaggatgtacaacataatgttttgatatgtatatacattgtgaaatgtctattatttttcttgattcctcaatcagacagcctatatgtgaggacagtgatgtgaatataatttgtgactgtgtgtgttttacctctttatccctgctaagaaaatagataaggaagttaagtggaaagagtatctttatatgagtaactatgaatctgatcttatttatcttttaataataatatagtcacaaatcttctgttctctaacactatctataaatgcctattgacacttttttaatatccctgtaaaattacgttgacactcaagaatatggttaagaggcatttctctactgagttacaaagattttataaacaaatttaaagggcaagcgatacattaggaaaaattatctgttacctatatgatgtacgaaaaagaaaaagtcacacttcatacagtttctagaacttagaaggaacaaaaagaatctactgaaaaaaaaaaaaaaagaatacaattcagaaattccctgaactagaaatccaaatggccaaaacacaatcccaggttcaattaacaaatccaactcttaacaataatgatacctcccagagcgctgcaggtataagcatgagccactgcaccccacctccacctttcctttttaactatcagtttcatatgcctgatttttttttacaataagcatgttatatttgtaatttttcgtttaacttaacgtcaataacgttttatactccatagtatagaaaaatatagtatacctattcttttatatttaaagaaaaaaatttaaattaaatgcagttttatcgaaatatgttgtgtcatttttttttttttgtccaaaacaacatagctgttctgcagtgagtgtatggagacaggtgttatcatatactattgataggagagtaaattggcccagtcatttcagagggcaatttgactgtatttctcaaaactctaaatgctcaaatccaataactgataaactctatttctaagaataagtcctgaaaagactttcagctggggctatacgatgtctgtgcaaagggccccctaccacattctacgacatttttatgtaacagtaaaatattggaaaatacctctgtatccaagtctggtaaaataattttgttgaatcaatataatggattacttgtagccaataaaaataagaagatgtgtgtgaaaaatgtatcttttaccgaaaaaaaagcaagttgaaaaaacaaaatctagttacaatacttttttacataaaagatatacacataagtgaatacatatgtgcatgtataaatgtatgagcccatatgatcgtaagaaaaaggtctaaaatggtatactctaaatagtctactactgggaattcggactgagtggctaagtgagacccctttctctttctctttctctctctccttcgaaaccgggtctctctctgttatccagactggaatgcagtggcacaattatagctcactgcagcctggagctcctgggcttaagtaatcctcctgcctcagtttcctgagtagctgggactacaagctcatgccatcatgcccagctagttatttttgttttgttttgttttttgtttttgtttttttttttagatagggtgtctcactatttctccaggctggtatcaaactcctggcctcaaatgagtcttctcctgggtcactgggattacagtggtgagccattgtgttccacctttctttttatttttgagacagggtctcactctgtctcccaggctccagtgcagtggcccggatctcagctcactacaacttccacctcctgggttcaagtgatcctcccacctcagcctcctgagtagctgggactacaggcacacaccaccatgcccagctaatttttgtcttttttggtagagatggggtttcaccattttggccaggctggtctcgaactcctgacctcaagtgatcctgttctgtcctgtaaaaaaataaaaaataaaaaaacactttcaataatatgcagcaagcttttgtttgggaggggagataatatgtaaatttaaactattaacttttctttaaggattactacaaaaatagattttaattcctatcattatggactattaacattttatattctactatttcaagcagttatgctaatttattttagagattcttcaactcttcttttccaacaaatattttataatgatctataaagataaaaaaaacagagccagtaaattatgactttcctgttatactaatgccacacattttatgattgtagtgacggaggtgtctgtcatgaaacaatgactaattgtaggaagtacaagccttctttaaaattaatgaagcttcagcaaaataacaaaatatgaaaaaaatcaaaattattttttacttcaaatatacatttttttcttttttttttttaattgacacaaggtgtcactctgtcacccaggctggagttcactggtgccatcgtggctccctgcagcctctacgtcccaggctcaatccatcctcccacctcagcctcctgaatagctgggactatagtcgcatgccaccatgcctggctaatttttgcattttttttttttgtagaaatggagtttcgccatgttgcccaggctggtcttgaactcctgggctcaagcgatctgcccacctgagcctcccaaagtgctgtgattacaggtgtgagccactgcgcccagccaattttgcaaattgaactttcaattataaaagattatttgtcttacttaagcattgttgtcctactaaactattatttctatgcattaattatgccttggtgactttaggtttgaaatcaaaacccattttcttttatataatattaacaacactattcagagctaagacgcattataactaatgatgcattatatacacttgattattaattttgctttttaagtgaataggaagagtggatatgaagagaatgcccacagtcctcattgctgtggagatttgctttccacgattttaaatcagggttatcagaaaaatccagtttctccctagaaaggtttaattagttacatttgttgaaaagtttgacacattctagatgctttatatttaagactgttttataattaaatgccatattatgaaagctcttcttgcttctgtattaacttattaatggatattgaattaaaatcataaaacttaatcctcactgttgaatatttcttaaatctcaactaataaacagttggcatatggacattcttattgaaatataggacatttttactggtgaatacatttttccacttaaaagtttttatgctgatataatataattggttccattaagctattataatataaattgcattcccctaaggtcattttagcctttatacatggttaaaggctttcatgagttatataaaactcagagctgtcaatgaatttactattgagtagcagactgccaagtagactgaacaactgaaaaaggggagaaaaagcaaaataatgataaaagtagataacatttatatagagctcactacaagtcaagcactttttaaattgtctcatccatattaattcatctaattctcatagtgatcttggaggttgatccccttatcatccccacattgcagaaactgaggcctggagaggttaagcaatttacctgttgtcatacaggcagtaaggaattaagctatggtttaaccccagatattctggctccagagcccatgctttgacttaaccactcttacaccgcctctccatgcaaattgctgttggatgattgaaatggtatgggtgcttagaatcaagtgacatataaggctgcagacaaagacagacctaagattttatcattttaattcactaccactaaacaattggccagaacttggactttctggccctgtacttatttctttcatagtctacaccaacatatttgacatgattccattatgctgccacaagtgatagactataaagagaagtagttatttgcttctaatattttgccagataattaatatagaaaatgatacattttttctcatcaaatgcaccaatgcatttttcactggaatatgaaccctggtttgcagaatggggctagtctggggcaaattcgcgactgccgccttgggttccaaagaccaggctgactcaggaggaatattactcaaggtaactgcagtttgtaaaacatgagcaaaaagaataaaaaaggaaaaaaaaaaagatcagagctgcaagtcacttgcatatggcaatcctgcaggcatgttaagaatgaaaacagctgggtgcagtggcatgcacctgtggccccagctacttaggaggctgacacagaaggatggctttaggctaggagttcaaatccagcttgggaaacatagcaaaaacctgtctaaataaataaataaataaaacaggatttaaataggaaaatgactagtgaaggaacccatcaggcaccattgttctagtcaaaactttagcattatcctagttggttatttccctcacttctctactgtgatatcagagcctttaggaagccttgaggttcatttccaaaacaaagtgagacatgcccgtgtttgccattgccatgactcctgcccgctattccaatctgtggtcctctcttcccaagagctcagccttggccccagctatgtgtccatttccatggcttttacacttgccctctcctaggttgtatccatgacacacagcagaggtttttaaattagaaatgagatcatatcactctcctgactaaaactcatttcagtgaaaataagaaagattgatatattcccatatatgttagaagaaagttcaaactccttgtcaaggcccaaagattctaaataattctgcctttctctaactccatctcatctcttctcccacctcctcccatcatgcttacttatttccagttatactgtttccccttcaattctgcaaatagccacactgtctcttgactttgtactttttttttccttctgtcttgaatgctcttccctagctcttcaaatgcctggctcagtctcactcagttctgggctcactgtcaccttttagagaaaccttgctgatcagttatttaaaacagggctccttatttattttctatcacatcaccatatttattttcttcacagcagttgccacagtctaaattatcttgcgtacttatttgattacctgtgtattgtctgctccagtagactgtaagctttaccagaacagcaacctattctgcctcatttgaagtgtgcaccctacgttgagcaaaatgcctggcatgtagtaagcaagtggtaaatgtctattgcatgaataaaactgatggtgaatcagtgtccacaaatgagccaaggaaaatggctcagggctgagaccatgggcaatgaacaagttctttgcactgtttgtgagaatagaaaggctggacgcagtcacattggggttgagtcctcaaactgtaataagcacaaataaaatgatgaaacatagtaaaagattgactgttccctgtccatctatctatcaatcatttatctgtttacctgttgcgtgtgtgtaatgtctacagctttatccttccataaaatgcatctgtatttggtaattttcaaatttaatcattatacgagcataattaaaatataggtgtttacatttcattttaaaaataaacacaaacacttatgagtttttagaatgcacaagtaagtggaatatcttgattctcaatctcagattaactaaagatatactttgtgatgcggcagtcaatttatatggttaaatagtgtatcattgaaatgtttgcacataatatgtgtaacaacgtttgaaataatgaaaccacaaaagcaaaggaaataattttgattaaaagtgaacatgtctttttggaagttaaaataatcaaatggtaaaatttacttctaataattgccatatttatttttttgccttccttttatttagagactagtaaacctatcccacaaacttctaaaagcatacagatgtgagaaaaactgaaactgaaatggtcattatttctaagtgcaggtttccttttcaactacagctgggttttgagcatatcttaattaacaaaaaaacttaaagaaagcttagcaaactttgaaggaggaggtcattgcattaatgttctttccaccattctcagcaatatcatttacacctgcttccctgaggtgttattccatatgccccttctggatataactatgtagggagtgtaagaatctttgcaaattgcttcaagagggtgatcatgattttaactgccactaccaatcaaatctgaaggtccatttatttaatgaacatgaattcatttaaaaaaggaaattaccaaactcatcatttaataacaaaaagggaaacaatacaaataaatagcataattaaatagcaaaaggcaatgagaatccaagcattttgagtatctgcaaaaggctaacaatgaattttacaaattaattgttgtaggacaggtttttttgtttgttcttttctcaggatggagtctcactctgtcgcctaggctggagtgcagtggcgcaatcttggctcactgcaacctccacctcccaggttcaatcgattctcctgcctcagcctcccaagtagctggggattacaggcacacaccaccatgactggctaatttttttttattattatttttagtaaagatgtggtttcactatgttggccaggcttgtctcgaactcctgacctcaagtgatcctcccacctcggcctcccaaagtgctgggattacaggcgtgaaccactgcacccggcctaggataggttttctcattgccattccattagagttttgaaaagaaatctattgaaaatctcattgaactatacacttatatcagtgatttttaaggcatataaattacacatcagtaaagtggctagaaaagttatataccaaaacttttttccaaccatatctctactctgcatcttcaactttgttcagtctatgccatagcactttctcctgtatccaccatgtattgcgttacccaaccttctgctgaacctaaatttcatcacatttttaaataagtaactctcctcttggaccttaggcttgagataaattttccacttttgagggatttttttctaaactataacttcatataatttcaccccttgatttttctatcctctcttcttgtctcctctcatgtcatctcctttcttctctttccttccttgcttcttttatcacttttatttctggctatatagtcaattcatttactcagaatgtcacccatcctaatgcatataaactgtgaaggactggcacttctctgaggctctgaggttactcttactttcgaatggaaattggagttcttaagcactttcttaaagctaaaattagtaggaatggctattcatttcgctcacgtgaaaagtgtcagaaatatcttggatcttattgaggttttatttctcactactagtacaagactatactccttgagtgtggagactgtcttttttttttttattttgagatggagtctcgctctgtcgcccaggctggagggcagtggctcgatctcggctcactgcaagctccgcctcccgggttcacaccattctcctgcctcagtctcccgagtagctgggactacaggcacctgccaccacgcccggctaattttttgtatttttagtagagacgggggtttctccttgttagccaggatggtctcgatctcctgacctcgtgatccgcccgcctcggcctcccaaagtgctgggattacaggcgtgagccaccgcgcccggccgccggagactgagtcttgttcatcttcatgtgcatctcccataattgaatgtctggcgcagtactcaaaaagtagtattcaccaaattttatgtacccaagagttccggagaagtttgttgcttttattattgcccttgttcactgaagcaatcgttccaaatgccaacatagggtcctacctacttcttattcagtaccgaaggtccacacctatgtggtatcaaatgatcattttgtaaataatatgatctctgtcactttactaaaaggataaataagctgaccacatatgtgagaaggaggagatggcaaaaagccaagactcttccttctgcttccttgctcccagactcttcaggaccttaccccataaattatcattttttttctcatctactgctaattgatccatcttctaagcaaacaatcatactccaaacactgcttttaaaaacaatctctccttaggtcctttccccaggatatagtcatttttctctttttgtagccctttttctcatctatcgttcgtcaacaatttatcatcaatatgatctatgctttatatccatcagcttcaatctagctttttcttctaccgctattatgacacttcttgtgaaacgagcacatatgacctcttaatcgttaaattatagagtttatacattgtttcttgtattttgtttacactgaataaatctatagaatttgtaataattgctaaacgggtgaaatcactgtagcaatttcagccttgcttattttcaatggcaagtaaacctcattctgcattgatggtgaattcgaatgcaaagatatttatttaccatctgcaattaaaaaaaaaaggtatgggggaaatacaatgaaaacaccaaacagtatttttatctaaaattactatagagtggtacaaacaaccatatatcataaactacattatgttgtgaaacagactgtgatgatggaaatcaagtgtatattagacagaagggttattctaactggaaggactgaggggtgaggtcagggctgctttaaatgttgttttccttatttttttccctgcctttatttttcttctttgagctattgttgtttgagtggttaataacacttctcagttcataggacattgtcatcaggggtctatgcaaggttctcttatattttatgaatttatttacttcccgtaacttcattctccactggagaaaattttatacagaagatcacataagacctggacctgcgtggatgaatagtaggatgtccacagaggaagtgaacggtgctccaaaaagagggaaaaggggaacagaggtaccaagaagtgatcgttgcttaagtctggggttagtggcagcatatatgtctggaaagattgttgcagcaagttgtaaaggtcttgatatcctgtgttaatacaattgcaacacaatgacgaattttgagcaaatgggttactggatctggctcatgtgagatcattctaacagaggtatagagaatctattttagaaactgggtcagaacaaagataactgagaaagaacatagaagaaactggactggggagattactttgaaggtggttcgttatctaaatcataatcacaattaagatttaaggtaacatttcccattgatacagaagtttaaaataagacagacgtctatatgcaattgatcttttcttccatactggtcctacagacctgatgttaaatgctttttaaagtgctcttgttatccctataaacattggagcttggtttccttgggaaatgtaagagcagagtttattagtctattcattcctagtactaaaatataatggatccagtggtagaatgaaagattcagtttccttaacttgccatatatcttttattacattagtgatgtgttttcctgatatttgtttccttgtaaactgtacttttctctctttctttgaattagttgctgtcaaggtgaatagctgaataatcttgcattaattattaatacttcttatgccaaagctaattaatggttttgcacgatttaaataaactacagtcttatataaagaaacagctactttctttagaaagctaacacatgtataaacatgtggtcataatttgaacatattaataatgtaagtttccaacacaatcatataaagagattagaaacaaggagatcctaagtcttctatgatggcattctattaaaatccaaattgaaatgtgtgaaaaaagtcacttaaatatatgtgcctataatctatctatctatctattatctatctaatctatctatctatctcttttcagccatctatctatttattttactgccttcattacctacaatttgtttgtgattctccagattcctttttttccatgttatatttatcaagagttttgattttggtcttggattttctgcgatttctttattattctacatttaattatttttataccccaacagttaatgtgataacctttttctattaatatccctttctccattcaagtatttatttttctctttcctctctggcatttctctgtgaaggaaccttgacagctttctatcgtggtgtctttatggtgatagcacagacaccctttgaagttaacatcttgttttctcctgaagatagtttctactccttctttattttctttgaccccagcccagacttcaataatgcattgaacttgctgtcgctgatagtccttctgctggtatttcattgctgtctctcttgctcagggtcagggacaaactctcagctattctcacaagattttaataggcttttactggcacttaacatttataaatagcaaacaacaaatgacacttctgttgcatgtgctacaaaataaggtttttgtacattgaagaacatatttcttaaataaaaaaattaaataatgtctctataactacataacagaaaataagaccaaaccataattatataaattaatattatttggaaactttttagaacatgttttatatttttatgagtacatgtaggcttggttatgctggagtaaaatatcaacaggaaaacaccagtgtcttaaagcaacagttacagccctagccaactgtccagggcagctgtcatctcagtttttggctcactagttcagactccgtgatcatcaagagaaaggtagagtgttcaggaggatccacaccagtagtgtaaggcattggcctaaaaaggaacaaagttactttctctgaaaagcccttaaccagaattgttcacaggtttttacctaagtgaaaagaaaaaatgaaaaagacacaaaagggtaattctcttaaatagctacagaagtaaataatcagatatggataaagactagaaatttctcccacaacatgatacaatagatttctattttactgccaacaacatattaattctactttactccgtggctacaaactttggaagatgttattagcaagcattagaagaagaaagagagataatttgttatggatgaggcattcaaatcttgataaatataaacaaagtatttgggactagaataaataatgcaaatacaaggtaaaataaaaaggatacatcagttagaggacagaaccattttgagagctttttggagatgagtgtggaaagaaaacagaaaaagtggcagagagggattgtatggaggttgtgaatggtgactattaaaaacactaaatgctgatatccacatatgctcatgtccaggcaagtccacagatggaaagatacttagctgtagcagaaataaggaatgggctgtgaggtttacaagaacagaccacccaacacctatgtgaaatgaaaacctggccaaggaccacagtcatgaattcaacttcattgtccagaaaactaactcatgcctcatagaaatattatggaagcatccattcctttttacataaagcccaattttaccgtatgcaaaaaatttacagagcatgcatatgcttgcaaataattcattttctgtgccctttattttactcataggttgaagaagtaaagaagtgtcacaaaggaaagatcttctgggtcctaacaggactaatatcagtgcccaaaatgaaaatgcattcttctgcatacctagttactgtttcggctggtgtttcttacttacagttaataaaatgttagacatccctctagttcacaggttagccaccccagctccccattcagagctccctagtgggaagctgttgagcctaaaattcatgattgtcagcctccaacagagaacttccacagattgctgctgctacagcttcaggatccaatccaagtcctgctttatgccagtctggtgtttaacacttagtctggtttattacttccaatcagtcctttttggggttatgttaactgaaattagtttctgttgtttgcaaccaaagaaccataattaagactgccctctccactccccacacagctgagatttttgcacccaagttgactaagaaactcctgaaaataaatagcaggtttaagatcctgttctagagagctgaatcacaagacatttaaaggagaataaacagggttcagttactaaattcctttactggagaaaatagtcaaaaagagaaaaagcaaacataactaaagagttttaaaatcgatgacatcagaagaatgtggtataatcaatagttacaggaagttagcctgtgaatgacttgtagacagtcaatggtattcacatatgcatacgcttccataaacctgttgttctttctcaactattccacatatggaaggggcatgtgactcctttccctctcctttattgattttcctcatggtcactattccaactgcactcagctagcggtagttgtcttaatatgtcataccctttaatgtgtatgtttttgtgcccaagttatttctccttccttggagtgacttttctcccttgtttgtctgtcacttcttagaatcagctgtcactctttgaaatctcagagtcaataacaagaacaactacaaaaatgatcactcactcactgctttctccctacagttcccagaacctactcctagtattccatttgtcaaaatgcagtttagtatttagttgcgtctgttatctttaatccactgtgacttcctaaaagtggggctgtgacttacttgtcattgcatatctgggaggtacttggtacttggcacagggtgaataatacttttttttttttccacacagatgaatgaataaattagtcatctagggttaagatttttccacctcaaaatctgacacatacacacctatttacaaaaccttatagaaccaagtttagataaaattaataaactgaaaactatcctgtccttttatatttaggttgtaaattcaatgtagataatggatggattcttattatgtgtgtgtgtgtgtgtatatatatatatatatatatatatatgaatttattttttaacagaagcatccaatgctttttacataaaacccaattttaccctatgcataaaatttacagagcgtgcatatgcttgcaaatacttcattttctgtgccctttattttactcataggttgtacgactatgtgcccatgtgcatgtatgtgtgtgtgtttttatacacatagatgtgtgcacacgagtctacatgtttgaatagattttgagaagcaattgtaatgcactattataattgaagtccaaattgactgcaactatgtcaatgagtgctgaatcaccagcctcactatttcctccttgaatagcctttccgtcatctccattttctcgagtaatgctccctaatcctacactgtaccttcactcccttcttgccttctttccattatgtttattcttcacggaactgacatcaactttattttcaaacagtgacttcgttttcaataaaccaagctagaaaacccaattctgtatgtattctgggcttggtttttttctgatgttaattcaccatattaagtttttgtcttggctctgcacaatctggtgattagcatatatgtataaaatagaaaagagcttttatatttaatgtacttttcatgcgcattgaaactctgggcagaagatgtggggtaaatgcaattactatgtagagtagcatggtaaatctcaaattacatgagaaatttacctagaattagatcagatacatagatgataggtaggtagatagataaattttatttaaaatgatcgtcatcaggagtgaatctccaaaacattgtgaagctgtagaacttatattgggtatttctttgattgcctgtgctcatccattcttccctttatgcaagcatccccctctggacctctcactcttcctcctcccacctaccctaatgggaattacccaccatgactgcaggccctccaggatgtggttcccaatttcctgtccctcagagtctcaactgccattctctagaccttgtccctgacacctatacttgacatactgtcatgtgctgtcctagagttctacttactcattatattcttttcaggtattttcttttcgcagggtcacactatgtgaaatgctcttatctcccctgggagcctgaaaaatgcagctttatcttgaaatctcagttcttctgagattacctgctccagaaagactcttccaactacacagtggttatttagatgaaattacctctattttctgccttatcaattctaatattgcacttgccatactgcatttatttctgcatagaatttttgtgtgagacaaaaggaaaaaatgcacccaattctcaagcactccctgtattctacaatgttccttcacggtgtctggccgttttgacgctgagcttgaccatgtgactcactttagccagtgggatgttagcaaacgtgaagtaagcaggggcttgaaatgagcttgtatattgaggcttctttgctcttgccttttgccattgccaggagaacctgcccagaggagcctgctggaggatgaaggacacgtggagcacagccatgtagcccttgtcatctcagccgtggccatcctggaccaaatgctcacctgcaatgtgttcattatacttgttgtggcaatgcataaccaatatggttgctttgcctgtattttgtgacctctttgtgagtgagacatctatgtcttgattaagtctctttcccccattcctagaacagtagttgatctattacattttggttgaattgaacctgttgaatgccgttattgttcctttctcagaaaaaaaaatgagtgctgtatcttatttctaacaggcttctaaacagtttagaacccctgcttaaaggaattctacaaaaaatattgagaactgcataacctctttagagtaatcaacatatgcaaataaccagtttatctacctctttagtgagccttaaactttgcaagagtataaaaaattatatattttttctcaatagtcttcatgtaattttctgcacttttctaaaattggttgtggaaattgtgcccggttttagagtggggggaaccagcaagtttggaaacatcatcagtgttcttgttttactcgtcttttagtaaacacattaggtctggacaaagtctaatgtatgtgcaagttcaacataaactgcatcgatcaattaagtaatctctccttttcatgtacttgataaagtactatttctcatatacatttttagaataaaaattacccataaatttgcaagatcggcaggtataaccagataaagacagttttcacttttgtataaataatgaaagtcatgcactcaagatagggactgtggaaagactaggaattctaggattcagcatatttgagaagattgctctggcccccctcatgaaggacttttcattcaagctttgaaagattcaatctatgcaaggatgtttctctaagctgctagtccaaaagtaataaacatcaagcttacggatgggtgtggaaactgaatggctttgcttttcttctgagggatttaatttatttttaatatcacaggtggcttgaggcgaggtgtaatcatctgtcactcttcagttaaatcatatcacctcacttctgaaatattctttgatctctctacctgtaaatcacgttctactttctctactatagactgtagcatatagatataataatgacatgacaaattaccaagagcatggagagtatgtctatttaaaagatgattgaaaaacacacacatgcaaatactaacccagacatttactttttaatgtttttcttcttttttgacttgttactagaatataaaattatatgaaacacatactgaagacaagttttaattttttttaatttaaaacacatcaggcatttcttttttactggctttatagtttaggcaatattaacaccttacatctgtaattttagcattttgaatacacagtttttaatgtacattatccattgggcagatccatagaacaagctaaaactttccagattcacattactttaaaaatattttgatttgctgggtgtggtggctcacgcctgtaatcccagcactttgggaggccgaggtgggcagatcacgaagtcaggagattgagaccatcctggctaacacagtgaaactccgtctctataaaaatacaaaaaattagctgggcgtggtggcgcacagctgtactcccagctactcgggagtctgaggcaggagaattgcttgaacccgggaggcggaggttgcaatgagccgagatcgtgccactgcgttctagcctggcgacagagcaagactccatctcaaaaaaaaaaaaaaaaaaaagatttgttgtcatatgtcttagttaacaaattttctgagggggtcattgggtaaagtatgcctcactagattatgttaggaaaagtgatgggacattaatttgtgttattccaatataaaaagggcctcttttcttcccccaatcaatctaactattaaatcacttataagaaacttaaatgtcacaataagataccaactgtcttgaataaaagtcatagatgcacgcctgtaattccaggactttaggaggtcgaggtgggtggatcacgaggtcaaaagatagagaccatcctggtcaacatggtgaaaccccgtctctactgaaaaaaaaaaaaaaaattagctgatcatggtggcatgcacctgtagtcccagctacttgggagtctgaggcagaaggattgcttgaacccaggaggcggaggttgcagtaagccgagactgtgccactgcactccaacttgagtacagagcgagactccgtctcaaaaaaaaagaaaaaaaaaaagaaaaaaattcatacatggaatgcctttcaaggaaacattaccttaaaaaagtgtaatattataataatcaaaatagccaaattcatataattttacaaaaaaacaagatttgctgaaacggtgaatcaaagaagtcattgtgaaaacagctttagctgcataaatgataaaatctagaaatagggatgagtgttattgaaaagaaggcttctgtttatatgaagaaggaagtctgaagagataagggaaagtgatatactggctgagtgtcctttatgcaaaacccttaggaccagaagtgtttaggatttaaaattttttagatcttagaatatttgtatgtacctaatgagatatcttaggaataggaccgtcatctaaagatgaaattcacatatgtttcctatacacttaatacacatagtttgagggtaactttatgcaatattttaaataattttgtgcatgaaacaaaattttggaaagcaaaggttccactgtctccacaaaccatgtggacagtctgtagttgattggcatcaccatgatttctcactctgaatttatacactattgataagcaatcatcttcttacacttatttgcacataagtacttaacagcaaaaaaatgtgacatggtattttcagcttattttctaataaatacttattagtcatataactgctatcctaatgtttatgttgttagatcaaaaaaatgaataagtatgttaaaggacctcggacttccaaaataaattggtgggcattattgatgttttatttctctgaagcctaccaactccatttcctgattcttcataggactttttgacatattgcttcaaactcttagatcaatgacatattaatccctagatttaaaagaattattgctatattaggcagtatgcatttagttgcaagtaataattttttaaaaggagctgatcaaaagggaatatttattataaggatacagtcatagtgggcagcaatatacttaggcctctggaatgacctgagagagaggactggacagaagtcttctctctgtccttgtgtttcttatctgaattcatttgattaatcagtatcttgatcaaaaataaacagcttactctaactgagtaatttgggcagaataaagagacatcttatacagacaaggtatagcacagctccctggcataaggaagaccaaggagtcatttccacatctaggtctggaggagaaggagcagaacagaaaacgcacagaggaaaactgcatgggaaggacaccagcaggttagcgctgcccctgtatctcagaactagcagcaggaatactccttaagatgccattttttggacctttcttccattgtctcatatctctttctaaccagagctgggaaaagttctccacttttcagggttcatatgatttgactgaacacacttagatgacccaagataatctctccatctcaatatcatgtattcctttgggttctgtaaaatgcaaattgtcctggaatacccaatgcttgaagcacttttttataaggtgtggtgcagttgtagtgtaagaatttaacccccatgagagcagagactgttttccttatcctttgttttgctgtatcttcaggatttagaatagtatttggcacataaaaggagcaaagtaaatattagttgactgaatgagtgagtgaatgagtggagagagcaatgccaagagagagatctgtagttttgagaagtaacatataggcaaagagagaggtttcatcaatacagcccctgccattatctctctcccggattacttccaagagtcccactgagtttttctgaattgcattaatctcaaatccattcctcattttaagactaaaatgggatttcttttgccatgtcgaattattcacttccttggttaaattccaactgaggtttccttttgcctgttgtataaaatcaagttcttacaacacccttgaagattggccccgagtacctttctcctcacattgtgctctgcagctgcattaaaaatgttctctttccttgctcacctcctgtcctttcttatcttgaggcctttgtcggtgctaattcctctactttgtatgccctgccatcttgagacacccttgtctgtcatctttgtttgttcttaatactaaacacaggtgctccaccctccacaaagcttcccttgacacttaaactccaagtttgctcctagaacctcctctgtatagttttctaccaccccagaagatgctgcatcttgttttttggctgtgtctcctatcaacttgatgtggggaaaagcaaagcaaaataaaacaaaactttattagtgccagaaaaaaagaatcatcaaaaggatcaccctttagaactatatattatacttcctgctaattcattccacttttccctgaggaaatgctatgtacacatgcatgtgtataaacccattgttatgttaattcaaccaattagtttttttttaatttatcagtctcctttttcctcatgaccatccctaaactcagaatcaaatttccagctcaattatatttaatctggtatatttcatggtctctacatttatggggttttttttctccatcttttctacacaagaaccaatctagtattgggccctcattttaattagatttttatcttgtttttaataattcctatatatgtgcttttttgtaaattttaaaatctaattcattaaactttaagttagtgctttttgaacacctaggattgccataaaaagaaacaaacacgcataaaaaattggggggacatagtttctagaaaggaaaattcttaccactgatattttttcttttccgggagtcaataactccagcaaataaatacttccaaaagaactgtgttctgtaatgtggaaatgaaaaacaaatctagttaattcattcagaagatttttctgtacctgtatttaggaataaatttgcatcttttacattggttccttttgtcattattgtaaatagccttggatggtaataacccactccattgctcataaaacccatttgatctgtgtttatcacttgctctataagtagctcttcatttctgtttgttgctatcatggttataaaatatactactataatagttcttaaacatacaatagcgctataaaacagtatctttggtgggtatttaagcaattttaatgctgagacaaaataatttaatttcctacccatatgttgaacgttccttaaggcactaaaaaaatctctaaaatccatatgcttgaaaatatctaaatttctgccaaacttagttcaggcttattagtaattcctaacgagtgaaatcattgtgattatacaagaaaaaattgattaaggtatggcagctttctctactatccactatttcagagctgaaaacaatacgtatatcagatcttggttctgtgacatctaaaagtatctacaacatttgtgagcaagaaaatgtagaacctatcaaataaactttgagaaccattaacttgttttactctacctgtaacactctctatagagctaaattaacattctttgtattgtcatttcaataaaaatgttatgactctttcatagttaaaatcaactttttaaattttcagtgctaaccattatcacttaataaacagcagttagattttgacaccttgatttattttaaagaaaagttaatatccattgagatgtgaattttacataaagagaataaacaaaatcagatgattatcttaatagatgcagataagccttgataaaattcaatatctcttcatgttaagagccctcaataaactaggaattgaaggaacatacttcaaaataataaaagccatctatgacaaacccacagccaacatcattctgaatgggcaaaagctggaagcattccgcttgagaaccacgagacaacaaaaacctctctcatcactactattcaacatagcactgaaagtccccgacagagcaatcaggcaagagaaagaaataaaaggtatccaaataggaagagaggaagtcagtctacccctgtttgcagacatgattctatagctaggaaacctcatggtctctgctcccaagctctttgctctgataaacaacttcaaaaaattttttaaatgtacaaaagtcaggtgcaattccaaacactagcaacatccaagctgagagccaagtcaagaatgcaatcctattcacaatcaccaccaaaagaataaatcatctaggaatacagctaaccagggaggcgaaagacctctacaacaagaattacaaaacactgctcaaagaaatcagagatgacacagacaaatggaaaaacattctatgctcatggataagaaaaaatcaatgtaattaaaatggctatactgcccaaagcaatttatggattcaatgctattcctaccaaactaacaatgacattcctcacagaattagacaaaactattttaaaattcatatggaaccaaaaaagcccaaatagccaaggcaatcctaagcaaaaggaacagagctggaggcatcatgtcacctgacttcaaactatactacaatggtatagtaatcaaaacagcacggtactggtaaaaacaaacaaacaaaaacagacacagagaccaatgcaacaaaacagatcacctacaaccatcagatcttagaaaaagctgacaaaaataagcaatggggaagggacaccatattcaataaatagggctgagataactgattagccatacggagtggtttgaaaatgaccgcttcctcataccatatataacaatcaattcaaaataaattaaaacttaaatgtaaaacctaaaactataaaacttctgaaagataacctaggaaatactattctggacataggacctggcaaagattttatgacagagtccaaaagcaattgcagcaaaaacaaaaattgataaatggcatctaattgaactaaagagctactgctcggcaaaataaactatcaataaacaaacaacctatacaatgggagaaaatatttacaaactatgcatccaacaaaggtttaatatctagaattcctaagaaacttaaacaaatgtacaagaaaaaaataaccccactaataagtgagcaaagaacatgaacagacacttaccaaaagaagacattcatgtggccaacaggaatattaaaaaatactcaatatcactaatcattacagaaatgcaaatcaatacgacaatgagataccatctcatgctagtcataatgatgactattaaaaagtcaaaaattaacagatgctggtgatattacagaggaaagggaatgcttatatactgctgatgggagtgtaaattagttcagccattgtggaaagcagtgtggtgattcctcaaagaacttaaaatgaaattatcatttgacccagcattctcattactgggtatatactcaaaggactacatattgttttatcataaaggaacatacatctgtatgttcattgcagcactattcacaatagcaaagacatgagctcaacctagattcccatcaacagtagactagataaagaaaatgtggtacacatacatatactatgtagctataaaaaaaaaaaaaaaacaatgaaatcatgtcctttgcagtgacatgggtgaaactggaggtcattatcccaggcaaacaaacaaaggaacaaaaaaccaaatactgcatgttctcacttatgggaactaataaatgagaacacatggacacaaagaggggaacaaaagagtctggggcctacttgcgggtgaaggctaggaggagggagaggaagagaaaaaataccttattgggtactatgctcattacatggatgatgaaataatatatacacgaaacccccatgacatgcagtttacctatagaacaaatttgcagatgcacccctaaatctaaaataaaagtccaaaaacgaccaaaaaaaaacaaacagaaaagaagtaaattttgtgaagtctttagtttataagttaaatatgctcaaaacataaagaaatcaagagttctagagtaattgtcatttatacaacatgaacaatgcaaacataaatttgaaagcttacataattctcaaaagaaccacaaattattgaaaaaataaacattttctatccatgtagatattgaccaaaatttttatagaaagagattaatgaataagcttaaattgtaaaagcaatctattgacatttccaaacctattgacttgatttattccagtactataacagtatataaaattatatattctatttataatagtacatgtaaatattacatacatagtattagtttactacataatgcatacagtattagtttattatgtaagcatatgtaactatacatatgtagttattagtttattcaccaattcaagtattcatcaaacttaacaaacatgtatttgcttacaacttactcaacatctgaaactgcacttcgtatcgaaggtataaaacttagcaaggtcagttttgcctgccagagctctcattcatatatgggagctaaatgagtggatctcatgaagattggtgatcaccagaggctggaaagggtagcatgaagggaaggtggttaatggtccaaacatacagtttgataaaagaaataagacgtggtgtttgatatattagcagggtgactatagtttacagtgatctataatacatttcaaaatagctagaagaaaataatttaaatgttattagcatatagaaaagacaaatatctagggggaggagccaagatggccgaataggaacagctccggtctacagctcccagcctgagcgacgcagaagacaggtgatttctgcatttccatctgaggtaccgggttcatctcactagggagtgccagacagtgggcacaggtcagtgggtgcgtgcaccgtgcgcgagccaaagcagggcgaggcattgcctcactcgggaagcgcaaggggtcagggagttccctttcctaatcaaagaaaggggtgatggacggcacctggaaaatcgggtcactcccaccctaatactgcacttttccgttgggcttaaaaaacggcgcaccatgagattatatcccgcacctggctcggagggtcctaccccatggagtctcactgattgctagcacagcagtctgagatcaaactgcaaggcggcagcgaggctgggggaggggcgcccaccattgcccaggcttgcttaggtaaacaaagcagccgggaagcttgaactgggtggagcccaccacagctcaaggaggcctgcctgcctgtgtaggctccacctctgggggcagggcacagacaaacaaaaagacagcagtaacctctgcagacttaaatgtccctgtctgacagctttgaagagagcagtggttctcccagtaggcagctggagatctgacaatgggcagactgcctcctcaagtgggtccctgacccctgacccccgagaagcctaactgggaggcaccctccagcaggggcacactgacacctcacactgcagggtactccaacagacctgcatctgagggtcctctctcttagaaggaaaactaacaaacagaaaggacatccacaccaaaaacccttctgtacatcaccatcatcaaaggccaaaatagataaaaccacaaagatggggaaaaaaccgaacagaaaaactggaaactctaaaaatcagagcgcctctcctcctccaaaggaacgcagctcctcaccagcaatggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagtaatggaagatgaaatgaatgaaatgaagcgagaaggaaagtttagagaaaaaagaataaaaagaaatgagcaaagcctccaagaaatatgggactatgtgaaaagaccaaatctgcgtctgattggtgtacctgaaagtgatggggagaatggaaccaagttggaaaacactctgcaggatattatccaggagaatttccccaatctagcaaggcaggccaacattcagattcaggaaatacagagaacgccacaaagataatcctcaagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaagagagtgggggccaatattcaacattcttaaagaaaagaattttcaatccagaatttcatatccaggcaaactaagtttcataagtgaaggagaaataaaatcctttacagacaagcaaatgctgagagattttgtcaccaccaggcctgccctaaaagagctcctgaaggaagcattaaacatggaaaggaacaaccggtaccagacactgcaaaatcatgtcaaaatgtaaagaccatcgagactaggaagaaactgcatcaactaacgagcaaaataaccagctagcatcataacaacaggatcaaattcacacataacactattaactttaaatgtaaatggactaaatgctccaattaaaagacacagactggcaaattagataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctaaaaagagacttagactcccacacattaataattggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcactacaccacacctattccaaaactgaccacatacttggaagtaaagctctcctcagcaaatgtaaaagaacagaaattataacaaactatctctcagaccacagtgcaatccaactagaactcaggattaagaatctcactcaaaacttctcaactacatggaaactgaacaacctactcctgaatgactactgggtacataacgaaatgaaggcatccttgatgaacattgatgcaaaaatcctcaataaaatactggcaaaccgaatccagcagcacatcaaaaagcttatccaccatgatcaagtgggcttcatccctgggatgcaagcctggttcaatatacgcaaatcaataaatctaatccagcatataaacagagccaaagacaaaaaccacatgattatctcaatagatgcagaaaaggcctttgacaaaattcaacaacctttcatgctaaaaactctcaataaattaagtattgatgggacatatatttcaaaataataagagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccgaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccagcttacaagggaggtgaaggacctcttcaaggagaactagaaaccgctgctcaaggaaataaaagaggatacaaacaaatggaagaacattccatgctgatggataggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaagtaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggacgtgaacagacacttctcaaaagaagacatttatgcagccaaaacacacaggaaaaaatgctcaccatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaaccatcattctcagtaaactatcccaagaacaaaaaaccaaacaccacatattctcactcatgggtgggaattgaacaatgagatcacatggacacaggaaggggaatatcacactgggttctgttgtggggtgggggttggtggggagggatagcattgggagatatacctaatgctagatgacgagttagtgggtgcagcacaccagcatggcccatgtatacgtatgttactaacctgcacaatgtgcacatgtaccctaaaacttaaagtataataataaaagaaaaaaaaaaaaagaaaagacaaatatttaaagtaatggatatcccttgggctaggggagggatagcattaggagaaatacctaatgtagatgacgggttgatgggtgcagcaaaccaccaaggtgtgtgtatacctatgtaacacacctgcacgttctgcacatgtatcctacaagttaaagtataattttaaaaaagtgatggatatcccaagttacactaatatgacctttatacattatatgactgtattcaattaccatgatgtacattcactactcattaatacaaatttttttaaagaaaataaaatagatatttaaaatgtggtatgataagtactgtaacagtggatggtagatcttccaaaacttactagttccttttcagtttggcatctacttcttcattttgttaaaataaaacataattgaatatttttgtgtttatcttaatgatattgtaatttacgatttttacaagtatgcaactttatgattttaataaaccttacttaaatattattgtagccaattaagtaaagctaatccagacatctatgcatcaagtttgttataggtggtgacacactgtaaaaatgtgtacacatttatgtaacaatggaattaagtttttaatttattcctgctggtggataataacaggaagtcagggagatggaggcacagttgctatctatccagtcacatattgtttgcgactaagcaccattcaagagaccttctttctgcctcattaaataagttaatcatgtaaatcacagataaaatttgagaatatatggatatagtttacacataaatgatgtatttttattgctgagaataaaaacagatgtgacaatgcccaggtgtcagtcacaaaatattatcattctttagtatctaatatgaatgaatggaaaattaaaaggtcaaattgagatatatatatgtatgtgtatatatatataatctgtagaacataatcaccaatacaaatcattctccataattaaaataagtctaagtagctcaactgctgtgataagaatttaaaatgagccacatatcatatctggaaatggcattgagagactttttaaacagaagctccaaaaatccatcattttatgaacaaaatgtctattaatataggtttagtgagttcatgactcatgtcatggctaaatcctttttatttttcacagtccctcagtactccacaaaccttctactgttgccagcagtattagtagtgtggccagacagaggatgcaacacctgaaagattgatgcagaacaactaaataaatggaaaggcaaacgtaaacatgatcatttcaaagcaaataattacagtcatgtctctggaggcaaatattggcgcaaatttgtcttttcaatcagtttaacatgctttaaaaaacttctctttcgattttgtttgatccatggttatttaggcatatcttatttagtttcaaatacttggggattttccacatatatggttactcatttggaagttaatcgtattgtggtcaaagaacatacactgcataattttaaatgttttagatttgttgagacttactttgtggcttagaatatggtctatcttggtaaacgctttgggtgcccttaaaaatagtgtgtaatctgctgttgtacagtggggtgttccagaaatgtcaattaggacaagtggattatgttgtcgtttacctcttttatatccttactgattttctctctgtcctgtcagtcattgagacatgaatcttgaaatctctaactgtaattgtggaattgtctgtttctcattgcaattctatcatttttgacccatgtatttttcttaatttttaggcacataagcatttatccttctgataaattgacccttttaacccatggtaatattgtttgctctgaaatctactttgtctaatattaagatagcccacacagctttttgttgttgttgttgtttaatgctggcatagtttgtatttttttttatttctttaattttaacatatttggggatagcagattaagatggcagataggagacaggactagccttgtagctcacgcttggaggaacagagcaggatgtggaggctcacatcctcaacttttgctccaagaactactgcaagaatgtaccaggaaagctaagagaatccacacaccctttgaaagaattggatcattgctgcaggctccctgagacactgaaaacctgtgagtctgcttgctttttcaatggggaggttcctggtctggggccaattctcagccctgctcactggttgcctggaaatagactcggtgctgctgtggggtcacggtgggagtgagaccagcctttaggactgcaggctgctgggagcagggtgaggcctgtgactgctggctttcccctacttccctggcaacctggatgagtaagcagaggcagccataatcaccctcggaatataactccattggactgagaaccacaccccgtcctccacatgagctgaatgaagcaagccccgcccaaggagagactgaattcagatatgcctatccctgcccctaccctgtggtctttatctaccagccctggtagctgaagacaaaggtcataatcccttgggagctgtatggccctgtctaccacctgaggaacctgaatactgaaccaggtgtccctagggcaagtttgcatcctgcgcacaggaccacagataatgggctcttgagagcaccacctcctggctggaggccgaccaacacaaaaccagcacattaaacaaaaacacaaccaaggaccctcacagattccacttcactcccctgctgcctccaccaaagcaggcgttggtatccacagctgcaagacctgaaggtggatcacatcacagggctctttgcagacatgccccagtaccagcctggagcccagtagctccgctgggtggctagaccaagaaaagcaaaaagtatcactatagtttggctcacaggaagctccattcctaggggaagagggagaacactacatcaagggagcaccctgtgggacagaagactgaacggcagcacttgaatcttagatcttctctctgacatagagaaggaaccagaaaatcaattctggtaacatgacaaaacaaagttcttcaaaacctccaaaagatcatgccagctcaccagcaatagatccaaagcaagacaaaatttctgaattgccagaaaaagaattcaggtcaattattaaggtaatcaaagaggcaccagagaaaggcaaaatcaaacttaaatcaaaaacatgatataggatatgaaaggaaagtaattcatccaacttgccagtctttgtcttttaattgggtcatttagcctgtttacatttaaggttaatactgttaagtgtgaatttgatcctgtcgttatgatgctgcctggttattttgcccattagttgacgcagtttcttcatagtgtcgatggtctttacagttggtatgtttttacagtggctgatagtggtttttcctttccatatttagtgcttccttcaggagctcttgtaaggcaggcctggtggtgacaaaatctctcaccgtttgtttttctgtaaaggattttatttttcctttgcttatgaagcttagtttggctagatatgaaattctgggctgaaaattcttttctttaagaatgttgaatattggcccccactcttttctggcttgtagggtttctgcagagatatccactgtagtctgatgggcttccatttgtgggtaacccagcctttctctctggttgcccgtaacattttttccttcatttcaaccttggtgaatctgatggttatgtgtcttggggttactcttctcaaagagcatctttgtggcattctctgtatttcctgaatttgaatgttggcctgtcttgctaagagtcaaacacatcggtgggctgtatttaggagactcatctcatgtgcaaaacacacataggctcaaaataaagggatggaggaatatttaccaagcaaatggaaagcaaaaaaaaaaaaaaaaaaaagtacaggggttgcaattctagtctctgataaaacagactttaaaccaacaaagatcaaacaaaggctaagaagggtattacataatggatcgatgcaagcaacaagaaaagctaactatcctaaatatatatacaccccatactggagcacccaaattcatcaagaaagttcttagagacctacaaagagacttagacccccatgtaataatagtgggagactttaacagcccactatcaattttagacagatcaatgagacagaaaattaacaagcatattcaggacttgaactcagctctggaccaagcagacctagtagacatctacagaactctctaccccaaatcaacagaatatacattcttctgagcaccacatcacacctattctaaaattgaccacataattggaagtaaaacattcctcagcaaatgcagaagaatggaaatcataacaaacagtctctcacaccgcagtgcaatcaaattagaactcgagattaagaaactcactcaaaaccgcacaactacatggaaactgaacaacatgctcctgaatgactactgggtaattaacgaaattaaggcagaaataagtaagttctttgaaaccaatgagaacaaagacacaatatagcagaatctctgggacaaagctaaaacatagtttagagggaaatttacagctctaaatacccacaggagaaagcgggaaagatctaaaactgacaccctaacatgataattaaaagaactagagagacaagagcaaacaaattcaaaactagcagaagacaagaaatcactaagatcagagcagaactgaaggagattagagacacgaaaaacccttcaaaaaaccaatgaatccaggagctggtttttataaaagatcaacaaaatagaccagtagccagactaataaagaataaaagagagaagaatgaaatagacacaataaaaaatgataaagggcatatcaccactgatcccaaagaaatacaaactaccatcagataatattataaacacctctatgcaaataaactagaaaatctagaagaaatggataaattcctggacatatacaccctcccaagatgaaaacaggaagaagtcgaatccctgaatagaccaataacaagttctgaaattgaggcaataattaatagcctaccaaccaaaaaaaaaaaaaaaaagcatgggatgagacagattcacagccaaattctaccagaggtacaaagaggagctggtaccattctttctgaaactcttccaatcaatagaaaaagagggaatcggccctaactcattttatgaggccagcatcatcctgataccaaaaactagcagagaaacaacaaaaaaagaaaatttcaggccaatattcctgatgaacatcgatgcgaaaatccttaataaaatactggcaaaccaaatccagcagcacatcaaaaatcttatccaccacgatcaagttggctgcatccctgggatgcaaggctgattcaacatatgcaaatcagtaaacgtaacccattacataaacagaaccaatgacaaaaaccacatgattatttcaatagatgcagaaaaggccttcgataaaattcaacagctcttcatgctaaaaattctcaataaactaggtattgatggaacatactcaaaataataagagctctttatgacaaacccacagcctatatcatactgaatgggcaaaggctggaagcattccctttgaaaaccaacacaagacaaggatgacctctctcactactcctattcaacatagtactggaagttctggccagggcaatcaggccagaaaaagaaataaagtgtattcaaataggaagagaggaggtcaaattttctctatttgcagataacttgattgtatatttagaaaaccccatcatctcagcccaaaatctccttaggctgataagcaacttcagcagtctcaaaatacaaaatcaacatgcaaaattcacaaacaatcctatacaccaataatagacatacagagagccatatcacgagtgaactccaattcacaattgctacaaagagaataaaatacctaggaatccaacttataagggatgtgaaggacctcttcaaagaaaactacaaaccattgctcaaggaaataagagaggacaaaaacaaatggaacaacattccatgctcatggataggaagggccaatattgtgaacatggccatactgcccaaagtaatttatagattcaatgttattcccatcaagctaccattgacttatttcatagaattagaaaaaactactcaaaatttcatatggaaccaaaaaagagcccatatagccaagacaatcctaagcaaaaagaacaaggctggaagcatcacgcttcctgacttcaaactatactacaaggctaaagtaaccaaaacagcatgggattggtaccaaaacagatatatagaccaatggaacagaacagaacagaggcctcagaaataatgccacatatctacaaccatctgatctttgaccagcctgacgaaaacaagcaatggggaaaggattccctatttaataaatggtttttggaaaactggctagccatatgcagaagactgaaactggaacccttccttacacctcatacataaattaactcaagatggaataaagactaaacataagacctaaaaccatgaaaaccctagaagaaaacctaggcaataccattcaggatataggcatgggcgaagacttcatgacaaaaacaccaaaagcaatgacaacaaaagccaaaattgacaaatgggagctaactaaactaaagagcttctgtacagcaaaagaaactatcatcagagtgaacaggcaacctacagaatgggggaaaatttttgcaatatactcatctgacaaagggctaatatccagaatcttcaaggaactcaaacaaatttacaagaaaaaaaaaacaacccatcaacaagtgggcaaaggatatgaacagacatttctcaaaagaagacatttatgcagccaacagacacacgaaaaaatgcatgtatgtttattgcggcactattcacgatggcaaagacttggaaccaacccaaatgtccaacaatgatagactggattaagaaaatgtggcacatatacaccatggaatactatgcagccatagaaaatgatgagttcatgtcctttgtagggacatggatgaaattggaaattatcattctcagtaaactatcgcaaggacagaaaaccaaacaccgcatgttctcactcataggtaggaattgaacaatgagaacacatgaacacaggaaggggaacatcacactctggggactgttgtggagtggggggaggggggagggacagcattaggagatatacctaatgctaaatgatgagttaatgggtgcagcacaccagcatggcacatgtatacatacgtaactaacctgcacattgtgcacatgtaccctaaaacttcaagtataataataataaaatttaaaaaaattaaaaaaaaagaaagaaaaaaaaatgctcatcatcactggccatcagagaaatgcaaatcaaaaccaaaatgagataccatctcatcccagttagaatagcaatcattaaaaacgtgggaaacaacaggtcctggagaggatgtggagaaataggaacacttttacactgttggtgggactgtaaattggttcaaccactgtggaagaaagtgtggcaattcctcagggatctagaactagaaataccatttgacccagccattccattactggttatatacccaaaggattataaatcatgctgctataaagacacatgcatgcatatgtttattgcggcactattcacaatagcaaagacctggaaccaacgcaaacgtccaacagtgatagactagattgagaaaatgtggcatatatacaccatggaatactatgcagccataaaaaaatgatgagttcatgtccttcatagggacatggatgaagctggaaaccatcattctcagcaaactatcgcaaggacaaaaagccaaacatcgcatgttctcactcatagctggaaattgaacaatgagaacacttggacacaggtagggggacatcacacacagggcctgttgtggggtggggggagtggggagggatagcattaggagatatacctaatgtaaatgacgagttaataggtgcagcacaccaacatggcacatgtatacatatataacaaacctgcacgttgcgcacatgtacgctagaacttaaagtataataataaaaaaaaaaagagaaaaacaaccccatctaaaagtgggcaaaggatatgaacaggcacttctcaaaagaagacatttatgcggccaacaaacatgaaaaaaagctcatcatcactgttcattagagaaatgcaaatgaaaaccacaatgagataccatctcacaccagttagaatggcgatcattaaaaagttagggaacaacagatgctggagaggatgtggagaaatagtaatgcttttacactgctggtaggagtgtaaattagttcaaccaatgtggaagacagtgtggtgattcctccaggatctagaacaagaaataccatttgacccagcaatcccattactgggtatatacccaaaggattataaatcattctactataaagacatatgcacacatatgtttattgtggcattattcacaatagcagacttggaaccaacccaaatgtccatcaatgatagaatggataaagaaaatgtgacacatatacatcatggaatactatgcagctataaaaagaatgagtgaaaaaatatgtcctttgcagggacatggatgaaactggaaaccgtcattctcagcaaactaacacaggaacagaaagccaaacaccacatgttctcactcataagtaggagctgaacaacaagaacacacggacacagggagaggaacatcacacactagagcctgttgggggtgtaaggggctaggggagggatagcattaggagaaatacctaatgtagatgatggactgatgggtgcagcaaaccaccatggcaagtgtatacctatgcaacaaacctgcgcattctgcacgtgtatcccagaacttaaagtatgataaaaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggatgcttgaaaaatcactggaattgtgtatcaatcttaaactacattttgtctcctagagcagagtttacttatggttattcatttttcaattatgagactcgatttgtcatgtaaggagtgattttcttttttcccaacttttattttaagttcggggtatgtgtacagaatgtgtacgtttgttagttaaatgtgtgccatggtggtttgctgcatagatcatccgatcacctaggtattaagcccaggattcattagctatttttcctgattctttctctcctcccactcctcaccttcaaacaggccccaatgtgtgttgttccccaccatgtgtccatgtgttctcatcattcagttcccacttataagtgagaacatgcagtatttggttttctgttcctgcatcagtttgcatgctggtgaggttgtggagaaaaaggaatgctttgacactgttggtgggagtgtaaattagttcaaaaattggggaaaacagtgtggcagttcctcaaagtgaagacctagaggcagaaatactatttgacccattactgggtatatacccatagaatgtaaggaattattttctaatggttaatctgattactattttaggatgtagccacacaattctgggaatttcatttttattgaaaaccttttgacatgtagtccctaaactggaagttccttttgcacaaagaatttgacacccttctcagacatttttttcttgagagctgtctaagcaccatgcaagaggcttattatatactcaaaagtcacaatatgcctcataattttttttcctcaggaaaaatatttttcaaggtatcagtcttagaagagtcattcagggagaatgatttcctctgtcaattcaatgtatattgaaaagaaaaaaaagagtgtgatataacttgagaagacacaaagtgtaggcaacatttatgtggcaacatggcactgactattcaatctttattgatagctaatgagttttaccggatgtctacttggcttatcatagattattagagttggcttggtttattgtgtccaatcaggatggatttgcaatctaattaatttgttcctcacccctgttgaccttcaagggaataaacagaaggaaattcctagatcattgaatcactgctttcaccactacagagtcattcttctgcatgcagattgaatattaaaaaataaacagcttcacaggtgtttatttagggtgctgtgaaagaaaccaagagaagagctaaggaatttttctgtttatccttttctccaataatttcatggacaggtaaatctttaaaacacctctcaaaaacaccttaatttttttttaaaataatgtgacgaagcagcttttagttatttagcatttctaatcttgcaatctgacttagtggaaaatcactttgttttcttcatctcaggtttcaaaccaaaaatatagccataatgtgttctgcttttgtatagactgcataagataatatttataaaaatcactgtgaaacacagaccactcatcctatatataatatactacgacaataataggtgttgttgctgaattattctattttcaatgtttactatgatggttgaacacaaagcttgagcctattacgtataatttttttataaaatactctaaaagaagaatcaatacatgagaaaaaaattaaactttgacttcaacatagtctgtatggcagtgaggataaaatggctaaaagaaaaaacaagcaatatttgctaacaatagaagaaaatatcctggaatccattttttttcctagcaatagagggtaactctagaagttttttttttcttaccaaaatgccaagaatatacagcagagcaaaaagcatgcaaagcacagaagctgctttcagagtatgtcacagcagctgcattttgaaaagagttgaagaagtaaaaaacctgaaattttagtattacccatctctatatagttatgagttaatcataattctcttaagactgtaacttgaactattatacagagagatttaaaagtctttgaaaataaatatttgcgaacagtgtgattcagaatacaaagaaagatatttattttcctttagcaataatcaactgagtgttaatagtccttggagaggcagaacatttacaaattccttcatagaatattttaaaaataataaaagcaagttccatctacacttagaatataggttcattggccgggtgtggtggctcactcctgtaatcccagcactttgggaggccgaggtgggtggatcacctgaggtcaggagtttgagaccagcctggccaacatggcgaaacccggtatctactgaaaaaaaaaacaaaaattagctgagtgcagtggcaggcgcctgtaatcccagctactcgggaggctgaggcaggaggatcacttaaacacgggaggcagaggttgcaatgagctgagatcgcgccattgtactccagcctgggagacagagcaagactccgtcaaaaaaaaaaaaaaaagaagaagaagaagaagaagaatataggttcattgttaggtagactttataaacgttttttatccctttgctctctgttttaatcataagaattagtgatcctactcctttccacagtgactccttgcacttctctcttgaatataacagtcagtccttgcagggcacttacccagcagtcaggtgatctgttcttcacgagttttatttcacttgaacctctcaataacactgaggtattgatagtactattatctccccatttggcagacttgacactgaggccaacagaggctaagtaatgacttggttcatgcagttgaatagtgggagagtgaggattaaaccacaaaccctgtggttataaacacgatgagataacgctttgttatataaaccgagcctctcactctgtgacctttctcagaccctactccatccataattgttctctccactctcctgaccttctgtcactctctgtccctttgctttctccatctttagtggctccttttgctcagccatatattaaagcttttatgtttttcaaaactgcagtaataccatcgttcttaccctccagctccaactccttcctctgtgccaaggtcctcacagcaatggtcacttggcctccatttccactcttctcatttattttatctcacccaccatgaaactgaaagtgtactcttaaaatagagtaataaatttctgatttctagttttatttcagttcacattctactctaattgtatacaaaatttggcaatttttaccgcaatatcttccctccttttttttttttttatttttagagatacggtgttgttctattgcccagactgtagtgcaatggctcaatcatagctctctgcagcctcaaactcctgggctgaagggatcctcccacctcaactttccaaagtgctgagactacatgcgtgagccactgtgcctgtccaatatctttctttttctttttctttttctttttttttttttttttttttttgagacggagtcttgctctgtcaccaggctgtagtgcagtggtgcaatcttggcttactgaaacctctgtctcccaggttcaaggaattcttctgcctcagcctccagaatagctgggactacaggcatgtaccaccaagcccagctaatttttgtattttaatagagacggggtttcaccatgttggccaggatggtcttgatcttttgacctcgtgatctgcctgcctcagcctcccagagtgctgggattacaggtgtgagccactgctcccggcctggccaatatctttctctaaagtctcttcttcctttcctttttactcctgattttctttctatgtcagttcatttatttttattttttgtcctctctctccccttaagtgtttatgttttaagatttctgaccttttttctctcttctctccttgatctatcaagaatcattaatccacaaacaagaagagtcctaaatttctatctctagccctgactctcacctcagcatgggattcgtattacaaacagtacagtggacatcagcacctaaatgctatgtgggcttctcaaatatttccaaaaccaaacacatgatctcccactgccctcagaaatgtccctttcttcttcattttctatgtatatgagaatgaccattcagttatctaagcataaaactcaagacccttctcagttagttaaaatatttaaagtgtttagaaaagaccctgcacattataaacactcaataattcttagttaacactaaaattgcctttactagttaacagtactatttgccattgacttctcactcttcctcacttactatatccaactgaactcccgtcatgacaattcaatccctactaagtctctggacttttgatttctccttcctttttcactgccactgctttagttctttcaggctgtccattttcaaacaccagagctggtctccctgacttcagattctaaccattcccattacattttctcactgcctacagagttatcttgctaaaactcaagtggggtcaggcactctctgtgataagttcatgtaattgtaccacgtaaggcctttcccaatctaaacacaagctaccctgccagtcatgccacttggcatttagccgatgacaccttccatgctgtgctccagttagaactgcttctcaaccctaagactgaccatgccccgacatattatactctttttatacctatgctctatgccttctctttctgcctggaaaactcctacttcaatcttaaatcctattaaaacttttaactgttaatcttgattttaaacattactctttccctacctagctccctgtacacttccatccctaccccagtcaggcagaacagggtactgtctcctcagggtttctattttgtaaatttgtagaagcccatttttataacacaaaatcttaaataattgtttccacaatatcatatttttacaatattatgtttattgtccagtaattatgtaatagctaatcataactccaacgtatcttgaaggaggagcttcaggtttgtttatatttttattttcagaacgattcttatatttgacacacaacaaattcctaaaaactgcttgtaaagtgaatgaagtaaaacaattcttacatttcactttctcagccaacctactctttgattataattatggtagatactgcttttataacccacttcattcctcacatcctttacatttataccccaaatataaattggtaggaattctctaaaccattcagtgtctcattttccttacctgtaaaatgctgaaactactttataaggttgtcatgggatttataccatttatatacaaaaaacaattagaatataacaggtatctgattagcatctaatacaattaactattactatgattactcttgtattcgaatgttcctttttcctctgatacatttgtgtgcaatgctccctatgtttggatgataatgttttcttagttttcccacataaaagggagagatcagtgaatccctttataagataaaagacatatgtaattatattagtctattctcacagtgctataaagaaatacctgagactgggtaatttataaaggagagaggtttaattgacccacagttctgcatggctgggaggcctcaggagacttacaatcatggcagaaggcaaaggagaagcaggcaccttcctcacagggtggcaggacagagtaagtgcaaagagaggaaatgccagacccttgtaaaatcatcagatctcatgagactcactcactatcacgaggacagcatgggcaaaactgccccatgatccaattacctccgccttgtcctgtccttgacgtgtggggattatggggattacaattcaaggtgagattttgggtggggtcacagccaaaccgtatcaataattaagccctaaaatgctctttggttagaaatgatgagatttgttcttagggtagtaagaattattcttatgttattattttgttattataagagcaagaatttttagtccaattattacagtctccttttaaacaaacactttataagtggcttttgattatcgcaccattgtaaagggataccaaaggaaacctgaggataaggagtgagatgcttgctcttattttcacactggcagctaaacagacaaactactttctgctttttaagtgctcgccagttaaagctgcatgtgagcactattggtttttatttgtttgtttgttttacttcactgtttttttcaaagtactttatgctcattaacctattttctatgtggatattccaattaaatattagaacaaaaagttgtttacttttaagtttcttttaggagaatgaaagaaactcccaaatttctgcattagaatcgaattaaaatatagaaaagaaatttatctgtgagttcccccagctctgcaagatacgaatcatctctcatcactcactttttcaggcctcaggatcaaactagtgccagaggaggaccaggtgactttttttctgagggagagaagtaatgggagccattgtcattcctctcactttttaaatggattgagctgccatgggagctatttgtcaacaaaaacagaccagaactcattagttaaatacagatcatgtgagattcagggagcagcatatggaggggtataatgacaaacttaaaaacagccatttggttacaaattgtcttaatattaatagttacattctaccatttagttactacttcctaaatactgctatttacccataatacgtaataaaaaactaaaagatcgtgaaaggaggagagaaacaacgaatatactaaagttgttatggaaaatcttcgtagacttacagatattacacacatatgcatgtggcaaaaatactttttttcctttctgtccacattgtttcaaaactttcaggtgaatttttaattcattcattcatatttttttcttctatttacaaaacaaacatacattttgcagccattaagttccagggcctccggcaggcaaaagaaactaaaggccaataaaattgtcctcgagaagcttgtatttcttatgcagtgattttcaaagcatgttccttagagcaactacatgagacgtaccatgggaatttgttaataatgcaggcacctggattgactccaaattataatttccgtgcatgagcttccaaagtctttatgtttaacaagcaacctagttaattcttttgcttttaaaaaatttgcacactgatctaactgctttgctccactaagtgtggtctgagaaaggacaacggtatctacatttctcattccaattatatccaaattagagtcttttaacttgtcatccagtggttcacatgtacttcaaagtctaaagagtaataatctagtctatatgatttctggagccaaccatataatgatattatgtggaatggttggtgtgtgctgtgggagacacacctaaaaagttctccagaacttgaatcctaccatcacatattattctatttttaacatttctcaggtgaatctgtttcaactactatattttacttgggtttcttatttttgtttgtttatttctattggcactgaaaatttaagggatagtgatatgtagtttaagatgggttatcgtctggatatttgcctggtggaggggcatatgaacaatgaatatgaattgatacaaatacaccacaagtcagagttagcacaacatatcttcattcatccacttctttattttactcagcaaatatttatttatttattattttatttatttatttatttatttattttttgagatggagtctcgctctgttgcccaggctggagtgcagtggcgccatcttggctcattgcaagctccgcctcccgggttcacgccattctcctgcctcagcctccagagtagctgggactacaggcgcccgccaccacgcccggctaatgttttttttaacagatttttggtagagaaggggtttcaacgtgttagccagtatggtctctatctcctgacctcgtgatccgcccacctctacctcccaaagtgctggaattacaagcatgagccactgcacccagcctcagcacatatttattaggcttcttctttgagccagggatttagatagtatttaaaataataataaaagcaaatatttactaaccacttttactacgtattgatgagtctccttaattgtcacataagttactgcatttaactgtcacaaccctgtaatggagggacagtgattactctcgctttacaagtaaggaagctgaagcccagagaggtagaataacttgctcagagtcaccgagctagaatggattttattgggaacttaaatacgtatctctttcatcagagcccttccttttaacctctatgctatcctaatgctcagatttctgggactcagatcaccgaagcccttaatcaaacaaacctgtgaaaaatttatggtgaaaatattacatatgaggcaaacaggagggtcaatggaagtatggaaggaagcaagaattcacgaggagacagagaaggccagaagatgcttccagggcacatggacagagaaggacagtggtatcctagccttatggagcagaatgcacaacggcagaaagcatgagagaacacactgggtgtagggaacttaacatttcttggttttgctggagggtgagttttgagacaggggagaaattggaaatgatggacagaaagtaaaggatcagatattgaagagaatgatatgtcctgctaagtatctgacatttctcttataggtgatacaagtctattgaataattttgaactgataaattattatattttgcttcagataaattaattgtcaaacatagtgaaatcttttaaataacaataactccaaatggtttgttactgcaaattgtagtcttctgagggaacatataaaagaaacagctgtgtttctgagagagtttgtaggcattctgaccccaaggaaagggtaagcatgacatgttttcttataccagaggtcaagaccttcccagtggtttgtttttgacctggaaaattttgtgtgcacatttttttccctcagtcagtgacattattcttgcagagcaggtgcattcgaaaaattattttgtgttaatcttttataagcatgaatgatttttaagccatcatttaaaaaattattcctaggttttttggtagttttgggttctaaagactgcatattgttaggcacaataattaattgtgacgcactctacccacaaagaaatgtatacacccatcagcaagtctccattgggccatcaagtcgtctgcctgcctcagcctcccaaagtgctgggattacaggggtgaaacaccacacccagcagcctcaggaaactttcagtcacggcagaaggcgacaggagagcaagctcaccttacatggcccatacaggaggaagactaagggaaaaaaatgtgcacacaaaattttccaggtcaaaaacaaaccactgggaaggtcttgaccgctagtataagaagtaattttactagaagtaatgctttaataacaacaccaactccaagtactcaacaacatgatacttataaacctttacctgattaagccatccaattagccgttcaaagactgtgtaaatacagacatagatgatgtctgggggattacaatttgacatgagatttgggcagggacacaggtccaaaccatatcaccaggtgatcacagaaaaccaaaaaagagtaggaatatttaatgtagacatggtcatctgtgggtaaagtccttcttcatatcctatttatttaaccctcctcagagttagcagggttagtcacacactcatatgtacctttttctagaaaaaaataaatatttctaaaagtttgaattaagtgaactaaattatagttgactaatttttaaaaatagagtaaacagtcacaatttggagcacaaaccaagaggaaagaagaaggactttacccacagctgaccatgtctgcattaaacattcctactcttttttggttttctgtgatcacctggtgatatggtttgggcctgtatccctgcccaaatctcatgtcaaattgtaatccccagcattggaggtggggcctggtgggaggtgactggatcttgggggtggatttccccctcagtgttgctcttgtaacagtgagtgtgtgccgtgagatttggttgtttaaaagtgtgtaacacctctcccctcactctcttcctcctgtatgggccatgtaagatgagcttgctctcctgtcgccttctgccatgattgaaagtttcctgaggctgccgggtgtggtgtttcacccctgtaatcccagcactttgggaggctgaggcaggcagatgacttgaggtcacaagtttgagaccagcctggccaacatgatgaagctccgtctctactaaaaatacaaaaattagccgggcattgtggtgggtgcctgtcatcccagctactcaggaggctgaggcaggagaatcacttgaacccgggaagcagaggttgcagtgagccgagatcaggccactgcactccagcctgggcgacagagcctagctcaaaacaaaaaaaaaaaaaaaaaaaaagttttcctgagttctccccagccatgcttcctgtacatcctgcagaaccatgagccaatcaaatctcttttctttataaattacccagtctcgggtatgtctttatagcaatgccagaatgaactaatacacctggcgaatggaattaagttacacgatgatgcaatttaactaaatttcaagggatacgaaccctgctcacattgatacgatttctggtatctactacttgtagcatatgaaacaaataatcattggcttcttactctgtggttagcctggcattaacccaggagaggagggttctttgtcattctccctaactatgagatattgcttatgaggtagcataaagcagagatctccagcttagtgattttttttatgacccaaatcaggataccaacttaagcatttcagctcttatgcattaacaatctgtattctatgtacatttttcatagtaacagcaattttgtggtgtttccttattcttcccttttgtatcacagtggagcccattcactctgtttttccacacagtatatctttctaggtcacacccttgctgcctcaagaattttaacaagagttataaatctgcagtgtccagatacctggaaatctcttgctgaccttatccttcatcattttagcatgagaatttggtatgactttgagtaatgttgtgatttaagaaagcatattacagaaataggtggtgccctttgtaacacaacaaaaatgccatgagcccacaggtcctctgtcaataggccattctgttggttgttggttttccagctgtagagatgtcattaagatgcttctacttccttttctcaaattaaactgtttttctatcttatcttttttttttttttttttttttgcaataagtaacctgtgttttattggaaagaacataggaaatcaataaaatttaggtttgaattcaagctttggcacctacctgctaagtgattctcggattcccaatctgtaaaatggataaaacaaagccagtttcaaaagattgctatacattttaaattatgcaatacaagtaaaatgctaacattttatctgccatagagttggtcctcataaatatctagtgtcattgctattgtaattattttttttttgacagggcctcactgtgttgcccaggctagggtgcagtggtgtgatcttggctcactgcaacttctgcctcacgggttcaagtgagtttcgtgccacagcctcccaagtagttggggtttcaggcacccaccaccactgctggctattttttgtattttgagtaaagacaggttttgccatgttggcgaggctgatctcaaacttctggcctcaagtgctccacccgcctcagcctcccaaattgctgggattacaggcgtgagccaccacacttggcctaatattttgaacacattttactcttggctattgatgcacggagtgttagagctgaaatagttcttaattttggtctctcctactgtagatcaggaaggcaagagatagagaggacaaatgagctattcaaagagcagagggtcacaaatagaactagcgttctcctcaagccatcttgatccatcagtttcaattcatgctataatctattgtatagtatctgctctatgttgatatttccttactggtagcagtattcctcttcccacctcatagtgtatacttgtatatcattttgaagttgcagctaataatcaaggactctgtctaatgtttcatgtgaaacccttggacttcatgatattttgaatgttaaataatttcatcattttaatagtttatctcagcaatggcgtatgcaaaattagctggatgaagagtgttatctgaccaaggccaaaatctgtagcccagagacatagtacattttccctggcccagtggtgctggaatatatttaagcctttacagcaaactaaaacaattcatttaaggaattatgagagccaaactatttttttagagcctctgactgatacttcatgtgctaatagagaaaaatattatgatgtcaatgtttttctctttaaaatataatgtaatgtggcatgactgatatagccaatcttgaatattagaaatgatgcatcatcacctaattcatcaaaatcaatctcgaaaaggtcagtcttacttgaaaaataagttgattggccttaaatgaacatactacgatctcaaaattagagagagacctcatggttttgctaagttgttttttcaaagtaccctcatcacaaaatttaggcatgcaaatgtcaacaatttgtgtagttacgcatttaaaaagtcttcttcaatggaaacacacaaagtttcataactttcagtggctgatgcctaccgtaaataactaccacagattacatagtaaactcttcattactcagggattgaccagtcagttggtaaattaactgcgttctagattttttaattctctctcctcattgcatgtctgctggttacatcagtactcactagcaagtcaaacatcatgaaggaaaaaagctaaagaatatcccattgattttaaaaattatggagaaaacgtttaaaaattggctttcatttgaaactttgagtctctgtacacataatatatcaaagctccttctctttactatttatacaaggcactgtcttgcggtcagttatatattttaacaggtgaagagcagaggcagtaattttttaaaaaatttttctaatttttaatttgtataggtatatagtaggtatatatatttatggggtacatgagatattttgatacaggcatgcaatgtgtaatcatcacatcagggtaaatgagataatcattgcctcaagtatttatcctttctttgtgttacagacattcaattatactcttttagttatttttaaatgtatactacatttttgttgactgtaatcactctgtgtattaggccgtcctcacactgctataaacaaatacctgagactgagtaatttataaataaaagagctgtaattgactcacgcttctgcaggctgtacaggaagcatagcatcttctggggaggtctcaggaaacttacaatcattgtagaaggtgaaggggaagtaagatgcctcacatggccagagaaggagaaacagagagagaagggagaggtgccacacacttttaaaagaccagatctttttttttaattttattattattatactttaagttttagggtacatgtgcacaatgtgcgggtttgttacatatgtatacatgtgccatgttggtgtgctgcacccactaactcgtcatttaacattaggtatatcacctaatgctaaccagatcttacaagagctctatcatgagaaaagcactggaaggatggtgctaaacaattagaaactgcccccatgattcaatcacctcccacctggtgccccacctccagcattggggattacatttcaacatgagattttggggagaacacagatccaaaccatatcaacctgttatactatcaaatattagatcttattcattctatctaattatatttaggtactcgttaaccattctcagtttcccctgcatctctcactaccactacccttcccaatgtctgataactatcattctattctctatctccataggttcaattgttttaatttttagatcccacaaataagtgacagcatgcagtttgcctttctattcccagcttatttcactcaacacaatgtcctccagttccatctatgttgttgcaaatgacaggatctcattctttttatagatgaatagtactccattgtgtactgtaccagattttctttatccattcatctgttgatggatactttggtagatcccaaatcttggctattgtgaatagtgctgcaataaatacagagtgcagatatctcttcagtatactgatgtcctttcttttgggtacataccgagcaatgggattgctggattatatagtagttctatttttagtttcctgaggaatattctaggataaaaagatttttgttttctttcagcactttaaatatgacatgccattctctcctggactgatatattgatatattgtatatagtctgctgccagatatattggaatgcctttgtgtgttattttttctcttgctacttttaaggttctttctttatttctgacctttgtgagtttgcttattaaatatcttgaggtaatcttatttgggttaaatatcagcgttctataaatttcctgtacttgaatgttgatatctttctctaactttggaaagttctatcttattatttctttgaataaactttctacttctacccagctgaattctgccctgtgttgctttccactgtgaccaggaagcactgagttctaatgcaaagtcccgcaatcactgcactcaccctctctcaagtgcactgattttctttctgtgccatgtggtccagaccaggggacggcggagggatggtatcagtaattcaagactgtctttcctaccctcttccatgcttcttttcttgatattatgttaaaaccaggtattgtaatcactcatccaagttttggttcttctgaaggtgctttcttgtgtgaatagttgttcactttggtgttgctgttgtggagtcgatcactggagggttctatttggccatgttgctctgcagaggcagtaattttgatttatcaattctattagtttataggggttttgtttgattccttttactaatcttatgagtaattttctcaaacttgtgtttgcataagagagccattttgtgtgtgctgaaaggctgtgtgtgtgtgtctgtgtgtgtgtgtgtgtgtgtgtgtgttgcttaatgtcaaatagattcaaactattggtaattttgaattgaccagctgttttcatgtaaaagcaatgataatcaacattttggtgagatagggaggtaacttaagattctagtaattaaccaaggtgtaagcaacttaaaattatttccatctgtaaaattatcatttcaacaaattatattgttttagagcaatgaccatgtcagcaatgacaatgacaatgtagcaatgacaaggacaaagttaattctggttacaaaagaaataattcttgtttagtgaatcaaagatctccactcaaaatcacaccatttgaattcttgcagactttgaagcttaaatagattcttagccttcacaacccctgggcatttttaataagaagcatagtgtgattctctgcttgggtaaggaaataaaacagaaatttttctcgaaagggccataaggtatattacatccaattagtcctatcttgactctgtgaagttgtcccaaataagagtgggtgataactgtttgtaatttccaaccacagaattcaccttagtttgtactttgaatagttaatgcttggcagtagcagcttactttaatataggggacatctggaaaataccttgtaaacgatgaaaccaaaacattcaattgtccaaaaatattatggagtgaagaacacaaccacatataattaacttaaatgtacagaggcattatatttgttaaataatttattaataatattatttttcagttcttttcattctttgcaggaagttattatacatcaattttaattattttagttttatattttctgttgtctcctgtgattatttaaatcagaattaccatttcctaaacataattgcagattgaaacatgtgactatatttcttattttaattttttgttttataagcttcatctggtacatattaaccatgaaccttactctcattcaattcagctcatggtcagataccacaattgaagtagtatcactcctataatatttttaccatttattattgaaagcagttgagaattaatgattttaacagaagtgacgtttgtatacagttccattaaacaattaagataatacttgatccacagaatacattggaaactttataaattagaaatacgctgaataaatagacaactcatgctgagaataaatgttgaataaatcaaacaaatgtttcatcatacttggatccttccaatcagttatctaatttctacaaatgtattttacatttatccttttaagtccatttataatgtcatcgctctttgccaacaatactaaatgttaattaaattttgaatattttaatcactattacattgtgattgaaaaaaacagtgtattcaatctaattttaatgtgtctcaacctcagaaaatatttttctctggtcatattttcatgagtaaaaattatttccaattatattttaaccgtgtctttttcattattttaaacagtaaaattttaatatgtttactcccttcttgttttatgagtctaaatgctgtaaaataacaatagccaatgtgaattacgcaagcattttaaaatgtaaaaaaaagcaccttgatatgaaaagaaatgctcagttgtactctcaagacaagaatttaataataaatactatgcttaatgaagacagtttctaaaattaaaaaaccccaaagtgatacataacacagatattagtaacaaaaagagaggctagattacttcttgctgattctcacctacaccagcctccaataaatttctttcttttgaaactgcttttcacctgcttatctaaatgtgacttctatctctctatccctcagtcctccatttgtcatgaattgttctctcacctactgttcccacagttcactctctgccctgaaaattgtaatagtttctgtgttcataacttagtcttactctccaatgatttctcatattttatgattactgttacattaaatgttttatttccttgaccacattgtaaagtcatggaggactggaagcatgttttatgcttttggattgtccattatattggatacagtgccacggtcaacagcgtattgtatatgtacatttatatgctcccaacatatgtaaccctcttcccatcatcagcttcttttcccttgtttcaatgtttctcaactgagtagctccagcatgcctaccagcggccaaatcaaattatcagtattttccccaatctaataaatcagtaagtcttatctagtattccttctcaatatatcttgaatttatcactatctcccattgacactatcgtaggtcaagccattgttaatctataacttagcttgcactggccttctaactggtgtaactcttcaaaattgcttctttcaaaacacttgcttattcagtagccagagtgatgtttctaaaatgtagacataagctaatttcctgcttaaaatcaccagttgttttttatttggctcatgataaagtccaagctaagcagggtagcataaaagaactattatgatctggggtctgtccactttgccacctcatgccaaatagctcccttcatcactctcaatgtcttgttataccaaattatatcaaatacctttccattttacataacagtgcactttctacatgtatctcctcttcttcatatatgtattctcctacactttaccagcatgtattgatcttagatctttttacaaaaggtttagatgatttctcctccactcttgaaagaaatattttatgttctccaaatttgcttgcataatttctttaaatttgcatgtataattcattatgtttctccctattttaacagttgtcatttactgatgttataagtattcttctgtttgcccagtcatctgtaagtaaattacatgcagagggctatgttttcccatagtttaatcccaaatacttagtaaaaatatgtttttaaaatatttttaaatgagtgatgggtggtttggtagatggatggttaaaagaacaattttttaatacataataaatatgagttgaaccatgagaaatgaaatttatagagcactggtacaataatgtgtaattttcctttaaaatgtctttaaaattcatttaataactcattaattttattatgatacaaataataataatgatgaagttgggcagcaaaggtaataaggagttacattattgagcacttaatgtatgctagatagtgtgctatgcccatttatattactattatacacgccactcttaattgcttattttcttaccaagcttgagaaaagagagtcaatcagactgtagtgagccagctccagtttctgttttactaccaaaacgatctactttatagcctttcatttcttgtctttatctatgcaatggagacaatatttgctgactttataacaatatagttatgggaactgaggcaagatgttgaaaattattttaaactcagactacagaaatttgatataagccattccttttctaaattgtaatttatgttccttcaatatcagaaaataatattgccttcattcatatcaaaagtactccgtatctgaatctttcattccagccgatctgatatactcactatattccaaatagttcatgatggcatgtgtgaagaaaatagtacattgtgcatttctgcactcttcttcctagttttaaccgacaatttagttctcatggttcccttttctgacacctttatctttatagagttttttaaagtgacatttgaacatatgtaagttacctcaaatcttttttggaataggctagggagaaaatgagacagaaattgtgaaaataaaatgccagtcataagataactgaaaataaatgaagattggctcacctatcaggttataataatttttttaaccacaacattacgattccgtaagtccgtaggaagaattatttcaaaagaaatttccaaaagggcaaaaagggcagagtaggaaacttgaaaattcatctcctcataaaaacaacacaaaagctaggcaaacaacaacaaaaatcttgtctaatttgacttttctagaattctgaaaactaactaagatgctggagaaattgggagaccatttgttgaagaaatacctactgaatcttggtaagaacaatgagctttgaggtatttacacttaccctggttccatcccatactcctcatcttagtgatggtagtcatgaaaatgtactgtatttctagtacaggtaatcagtgctggagggagcaaaacagacctcgctcacaaataattgttttagcccacctggtagctccctgaaagacctgcttaaagtcaagctaaaagtgcttgccttaatgtctcataacatggaactctcccagtgctgaggttgctaccccaaggatgtttgtcaaaaatgttcacaggcaaatataatagtcactgtttcctggggaagtgaataaaagttggggcaaaaaaaaatagattaattaaaagcttaggatgaaaggctggagattgaaatgctttggggaataaaggctttgaaaatttcacatattctgggaatccagagggccacacgtaggtacagggcagtgcaaatcctcaggaaaaaccgaaaaaggcattaatctctcgccactgactaaccttcggtctctgcgctggcaagaagtgaatgctagggcagggatggtacacggcctcactagagtttaacacacagaagcccatctcaaaattctgggagatgtttttggttccaggcaagtatagaaatctctgtccaatcactagctgactactaacctcacagaaaagagatgttattgaccacacatgacaaagaatacagactttatgatattaattcagaaaagtcactaaacaaacaatcaccataacaaacagaacatgaaactctggagaagagaaaaacctgaattccatgcttgctacattataattctcaaaatgtccagttttcaacaacaaacacaacaggcattagacgtgccaacaaacaagaaggtatattccatgcacaggaaaagaagccattcatataaactgcctctgattaacctgagacattggtcttagcagacaaatcctttaaatcagctattttaagtgtgttcaatgaactaaagaaaatcttgcccaaggaactgaagaaaataatgataacaatgtatcaccaaatagagagtatcaataaagagaaagaaatttaagaaatgaatcaagtagaaattctgaagctaaaaagtacacatttaaggtactaaaaaaaaaaactatcaaccaagaaaataaggcattccataataaataaaaacagttttcactaatagacttgtcctaaaagaaatgctaaagggagtacttcagactgaaactaatggacactagacagctacttgaatccacacaaagaaattaagaacatggttaatagtaaataaataggcattataaaagtattatgtaaaagtcattataaatgcatttattgttttaactcctctattttgctatctgatttaaaagacaatagcaagaacaataattataaatctacgctagtggacacacaatataaaaagacaatttatggcagtaacataaagtttcagttaggatgaataagctctagagatgtagcatacagcacagtgactatagttaggaattatgtattgtacacctgaaaattggtaagagagtagatctcaaatgttctcataaccaaaaaaatgataagcatgtgaggtaatgaagatgttagcctgatttaaccatcttacaatatgtacatatatcagaacatcatgttatacaccgtgtatgcatacatatacaatttttgtcagttatacttgtaaaagctgagaaaataaaattaaataaagaattcgagttcagaaataaatcctagtacttatgttcaattgatttcaaccaaagtgctgagaccactcagtaaagaaagaatagtcttttcaacaaacagtgctgagacaatataatatcgaaaagaaaaacaaggagtttgggccgctatctctcactacatagaaaaactaactcataatggatcaaacgcctaaatgtaagacctaaaactacaaaactctgaaaagaaaatatacgtgcaaatttcatatatttgaattaggtagtggtttcttaagtatgactccaaaagcacaagcagcaaaagaaaaaaatggtaaactaaatttaatcaaaattaaactttttatatattgaaatatattatcaaggaagtaaaaaaagacccatgaaatgagaaataacgtttgcaaataatatatctcataagggtttaatatccagaatatgtaaagaccataaaattcaacaccgataagataaacaacacaattgaaaaatcagcaagtgatctggataagcgtttctccaaagaggatatacaaatgaacagcaagcacttgaaaagatgctcagcatcattagtcattagagaaatgcaaatcaaaaccacagtgagataccacttcatacccactagaatggctaagaaaaatggaaaacaggccgggcgtggtggctcacacctataatcctagcactttgggatgccaaggcaggcagatcacttgaggtcaggagttcgagaccagcctagccaaaatggcgaaaccccgtctctactcaaaatacaaaaattagccggacgcggtggcaggcacctgtaatcccagctactcaggaggcttaggcaggagaatcacttgaacctgggaggcggaggttgcagtgggctgagatcttgcctctgcactacagcctgggtgacagagggagactccatctcaaaaaaaaaaaaaaaaaggaaaatattaagtgttggtgggcacgtgagagaactgcacccctgatccatcattattgggagtataaaatgatgcagccactgtggaaaacaattaggcagttccaaaacctaaacgtaaagttattatgtgacacagtaataccactcccagataaagctcaggcgactgaaaatagttgttcataagaaaactcatgtttagagcagcattattcacagtagccaaaaggtggaaataatccaaatggccatcagctgatgaatgggtaaacaatatgtggtatgttcatgtaatggaatattattcagccacaaaaagcaacacagtactagcacacgctacaatatccatgaactctgaaaaattatcctaaatgaaagatgccagacacaaaggtcacatattgtacgattccattattgtgaaatgtccagaataaatagacaaattcatggagacataaagcagattagtggttgcaagtggcaggagctgagaggaattggtagtgacggattaatggattttcttccaagagtgatgaaaatgttctacaattagattgttgtgataattagacaccattgtgattttactaaagaccactgaattttacatttttaaatcgttaaaatggtaaattttatccctgtttttaaacatttacaaaaaaatttccaatacaagttttcaatatacatactaatatggaaaacaatgagaatatatttcatggcttgttgtgcattctatgtgaggtttgtttgatgaaaacacctttcttttcaactattggtctgaaactcacaatcatgttaaatcaggttttcccaatatccatttgtagagtctagtacagtacatttttactaggatataagcattttgaggatacaaatatttcttgtttagttaactgtttgcaactagcttattgacttacaaataatgagcatatcaataagtagttgtttaataaatttattaatttcctggcttgggggaaggaaggtaacatattatcattggcagtgctttgtcgaattcttgccttcagatttgaatacaaaaaatatgatttattgtcatagctacaagtaggatagagcagctaatatgttaggttcacagagatcagtcaattgataaatatgatattatactaagacttgaattaacttaatcttcagaaacccgtggaagctttactttatgtaatatgattattattatcatctttgatttcagtattaaatgctttgtggctccttagagtcctagaacaatgtaaaagaaggtagagaggaggtccactttcatataagtgagaatttttagctgtcagatagttgacattaatgaacttcacatttatctcttcctaacagcaatttttaagcatatatctgttaatctaggtctttcattatttccatacataagcccattgcaaaattcaccaaatgacacagtagactgtcccttcaataatattattagaaaaaaagtgcactgttgggttcattttttgtagtttcttgtagcaaccttagttaaactaaagctggaactaaacaactaaagtttacttgcttaatttaaccttcagtctatgatattctcatgtctgatctttattttagaaatacatattataggcccagggcgacggctcatgcctagaatcccaccacttagggaggctgaggcaggtggatcatgaggtcaggagttcaagagcagcctggccaatatgctgaaacccagtctctactaaaaatacaaaaattagccaggcgtggtggcacacagcttgtaatcccagctactagggaggctgaggcaggagaattgcttgaccctgggagatggaggttgcagtgagccaagatcacaccactgcactccagcctgggtgacagagcaagactctgtctcaaaaaacgaaagaaaaacatatcatacctgctatgtacaatttcttttcacaatataataggtttggattttaccttttattatatttctttcctcaaatattattattttatttcagcactccttttgaattgcccactctgctttaacaataatgctgttgtttatttgtatggtgcctgaaataaaccatgctattggtctaccttggctgccatttcttattcctcatccaacctgttttctttcaaagaggctagctcttattaaagaaagatgacaccaactagtaatgttttgactactttagactcctgaaaactgtgttttccatcattctcttgaacttccataaagcttgtcctggttttaatctaattttcataagttacagagctatgcaactcaacacaagaagcaatactaataaaacttactccaaagactaccactggaaatgttttgttgttttgaatcttactatgtcattcttggaaaaagtggctttcatttccaatgagggtagatttcactttgtttgaaaaagtggtagaagaaaacgacaggcgaagaaccacttaaacaggtcactttgaaggagttctttatacttgaaattctattctctcaagttcataatttttataattgaaatataaaatattttattttcatagtaaacctcaaaaataaaattaatatctcatgagcaaactatctgaaaatgttcatgtattgctagttgtccaagagtagtttgaagatgactcattgcaacactggtagaacgggcatcatttgtctgccacccagttctagaatgaagagccgactgcattttgttgcacccaagacactatgaggaaggatttgctcacaattttgtaattgaattcattaaaatttttactctcataaatatttgctatcatttagagtttcctgtcatataaaaaatgtagagttttgaagatacaccaaaaatgtgtcatattggactcactcttaaaaattaattaatcatgcagcatgtaaaacatatagaaattataaaggatgtaaaaatgaaaacaaaaaatggaaattataaagaatgcaatagtcatatctactacctagcttaataaataatatattgccaaaggtcaaaatatttgttgtttctttcttcctgaacatcagcctctgcagtaaacttgtttctgtatatgactgtcttaaatttccctgcatgtttattgcatacatacggatccttaaacaacatccgggggttggagggtgaggcagggcatatagtctataatttgcagaaaatatatatgagtcaaggatactattgtgtggagaccagcatgagcaaaagaatagacccagagtcattgaggtactattatgtgtagggtctggtaaacatgggtcactgaaggcacaccatgattataggttctgaatagcttttttttcttcttcttcttctttcaagagacaaggtcttgctctgtcactcaggctggagtgcaatggcaccatcatagcctgggttcaagtgatgctcctacctcagctccctcagtagctaggactacaggtgcatacccccacatcttgctatttttttgtttttttctagagattgggtcttctgtgttgtccaggtctgtcttgaactcctggcctcaagtgatcctctaatttaaacccccaaaagtgctgggatcagaggcataagccactggacctggtttacaggtcctaaatatctaagagcaatgccaacgtaagtccaatgctacacatcctctctctccaaatggctcaaaatggaggcaaaggagtgggactccaagacagaagatgtgagtgaattagaggaggaggagaaacaaaagaaacaaatatggggatatcggcttatagccatgtctacatttacaacaaccctgctcttttacctgcaacaaaataatctaaaacagcttattaaaaatagattagttttgttttattactatggcattaaccagtatgtgttcacaaatgaaggcagattgggaatagacttcgcttcactttcaaggttcctttcctcaattaagtctaaaagaggagaactatttccccactccctcatccccatgaaaaacaaaagaaaagaaaaaattctgtatctttaatttttttctaccaaagctgatacctgaaaatcttttacagctgcatctgctatttcctgctcagccctttcttaactctcttagatatgagctaaaagaaaatatgcccagataccaccttaccctagcagcatattctctacctgccttacccactctgtgtgccaacccacttgttctgatgcctgaggtagaaatagtagagttttggctgcaaaatgctttcttcttgcatttattatagatgacaaaaatattttggagttaaatggtgagatggagggatttttttttaggtcttatatttgactaaagatttgtgtttcttgctttgtgaaaatttaatattttaactgtattccagcagccctatgaaagtaggtaaggtagatgtactaaacccattaacatgataaggcaaccagaggctcagtggattgctaagatggtgaattgcttttttactaggtgaaattatatttttatggaaaggacagaaggagcagagtttgttttggtcttttgcttcgttttttgtaaatgtgcatgtgttagcaaaaacacaaagcagcaagaaaccaaggatgtggtaaattattcactttatgacttcaaagagcttctcttttatgactagcagcctcacagatcaatagataacgggtgtaaataagaatcatagaatttaggagttggacaaggctttgaaggttattcaggacaacccctcataaggagttatgttggtccaatattgcttggaaaagatgggctaggccagaccttccagtctagtctgagtttgagtttgtgtgagaagtttgactggaactaggtacaagcctactttttctttgatttacttacagagtaggaaataagaagggcaaagattgccaaagaactaagaatgctttgagggttaaaatttctgctgcgttcgcactggggcactcttgtacctgcgattgctctgcggggcttaggagatttcccatattgcccagtatgggcagaattgtccacaacctgccacaagaactaacccagactctgcgagaacattcccccacaatgggtagttgatatcatagaactttctttctcactgtaggaaaccctaatttgtcagcctttcttctactgctttatattgaaagcaaggctagcttttaatcataaagggacaaaaaaaaaaaaaaaaaaaaaaaaaaaggcacactcctagttaacacccagcttctactgctcttttagaagtccctttgtttcatggagaccagaaaaaaccatttacatttccaactctttgtcttttttattttattttattttatttttcactcggtctcccaaactagactgcagtggcgcgatctcggttcactgcaacctccgcctcctggattcaagcgcttctcatgcctcagcctcctgagtcgctgggattacaggcacctgccaccacgcccggctaatttttgtattttgagtacagacggggtttcgccatgttggcaaggctggtcttgaactcctgacctcaaagtgatcctcccacctcaacctcccaaagtgcagggattacagacgtgagctaccgtgcccggcctctttgtcttatttttgcagcctgaaacaaagaaaaagtcaacaatctttttttttatttttttattttttgcaagccagcccttcaaatacttaaatgaattatctctatttcacaaccattcacagccttggtcttcatctttgttttttgtttttcttgtccccaaatcccgacacatcttctcccatgatacaactccctattctgttgagtgccttcagcggaacactctccagtgtgtcactgccattataaaacgcagatctcttagtgaccccaggtgaatctcaatccttccccctgaatagcacgtttcaactaggaatccattcgtgtctatcttggtaatcctatacagtcagtcattccgctgagggttccacctaagggtgaccccaaacgaagggagggaggaaggagaaagaaaacaaaggtgaaagaaagaacaaatacagaaatataaggaagaaagaaaaagataaaaagaaagaagagggaggaacagaaggaaagatttaaaaagaagaagaagaagaatgcatctactttagcatattttcttaataaatcacgcaagttttaaagagtccccctcttttatcttctaaggtctcacaaactatttgataaacattacagtaggtatttcttttttttttttttttgcctatataatatgcactctcttttttctctaataccaatatcctaatttcctaatgaatccaggctccgtcactcctaggacaagtgctttgtgtggcagagctgtgtccaatgctagctttgtagacacatggtatgctgttctgaacaatcagatcactttatttctccaaccatgacaactggttcagagatggacatctgacctattcagagccattcagaattaacctcagtttttattgagaaaaccagaatagattctatttcaacacgatttggaagaaatcttgggaacattagtgacctcaacaggaaaaaaaaaaaaaaaaaagcaaacgtggaagaaaaataagctgatggcggggacgggaaggagccaggagataaaaacagcttcctgatagctggaaatagacaaagcaagctgcggttagttctactggagacgttttcccttactgatcttttttgtttaagcctcttgtagctgagtttcttttatttgcaacagaaagagacatgtctaatatttattttcccaaaatatgcatcaaatttcacttctttccaaattgattatttccagtttaaaacatgaggatgatgcgtgcacatctttagtactctcaatgtttccaacccttatcttcaatgtaatttactaacaattatttaaagctccctctctcactattgtaagctacacgaaggcagaaagcatcacttattttaatgacccttatagtttagtgcagtgccaggcacttagttaacacaccatataaatgtctagatagatagatatatagaggtaggtgataaagaaatttatatatatatatacactatatatatagtatatataaagaaatacatatataatatatgcatgtgatagaacgaaagaaaggataggtagatttatcgataggtataaagcccgtgggctgtgacttatgcctgtaattctagcaatttgggcggccgaggcaggtggatcactttagcccaggagtttgagaccaccatggacaacgtgacaaaaccctgtttctataaaatatacgaaaattagctgggtgtggtggcatatgcctgtagtcccagcactcgggaggatgagacggaaggatcccttgagcctggaacttcgagactgcagtgagcggagactgtgccactgcattccaacctgggcaacacagtgaaatcctgtctcaaattgatagatagaataatagaaataattaaatgaacgttatgtcaacttccctatggtctatacatcttcagcctttaatagcgtttgctttgggagctcattcacaacatcttttattattctgacaggtttcattggatcacgttctcctgaatgattttccccttctccctttatcctgggttatcagtttttctaactaaagaatgttcattttatgctaggaagctgagctcagagagatgctcctcaaatttttaatcttagaaaattttctgggaaacctatggacaaggtgctcacctcgcttgcaagaacaagcttagtatattcacaatcatacatttcattgtctctctgagggtcaatgtttcttgctgaagctcataatggatttgaaaatccttgtaatgcctaactcccctttaaacaattaaccagagtctcttggttcccttggagactattctaagacttaaaattgtttttcttctcccctgcccacactgcagctaaaagctatgaattaccacaataaacaatattgagaaatgtcaaaaatcatcatttcatcccatggaaaataatcaaagagcaaagatagagattcccttcctatttatgcacttgtttaagaagtgtctgacctctgtgggatcttctgggaaaactttgatattttgactattcgttattaaaaattcatagatagagatgaaaatgaatcatttactttttttcaatcataccaaaattggccaaatggcttttgcagctgacagtttccagttattctttgtgatggaaaagggctatcaatttatgaaggaggaggcatgatagtgacatccataataaaatttaagcaataatctgtacacaaataacatatttatcatccctcatgcaaaagctaagccatttgcaatttgtaaacttacattaagttcaaaataaagaaattttaaaaatgcatgctagttaaataaaatgcacagtgtttataattgggaaacataatatcaataatgatgatggtgatgattatagagagaaattatataggtttaaaagtatgccaggccctctaataagtgctttatgtaaattgattcatttactccttccaaagatcatttgaggcaggtaatcagctaggaaaaatattctacagagtatgcagtaggcacagcaagtgccaagggtctgaggtgagaatgagcacagcatgttgaagaagctaaaagacagagtagataatatgtcttttacataacaatattttatatcaattttcatttcctttctagtacaagattatttagaatattaaaattttcagttaaaattgttttttttcccttggctattcttttctgttgttttttttaaatattttgtttccataatgtggactcaattttcagtttcatataatttgtttttattttaattttgaaataatatattaaaatttaaaatattatttcatgagtgttggaaaaactgtattgttgttttaagattacagttctgtgtgtgtgtgtgtgtgtgtgtgtgtgtgtgtgtgtgtgtatgtgtgtgcatggctaccaaatcaaatttttagtagtttgaattttgctattcctctttgagtctaatgtcaaataaattttgtatgaagtatctttaaggctctaacatttaaggatcagtaaatttgtctttgtatttccatgagcttaattttgtatattttgatgctgcattttaaaaataagttacactcaagttttgttttttattgtattttaagttccaggatacatgtgtagaatgtgcaggtttgttacataggtaaacatgttccatggtgatttgctgtacctatcaacccatcacctaggtattaagcccagcatgcattaactatttttcctgatgctttccttccccctgcacactgctcccacccctcaactggccccagtgtgtgttgttcttctccctgtgtctacgtgttcacattgttcagctctcacttataagtgagaacacgcagtgtttgattttctgttcctgtgctagtttgctgaggataatggcttccagctccatccatgtccctgcaaaggacatgatctcattcctttttatggctgcatagtattccatggtgtatatgtaccacattttctttatccagtctattattgatgggcatttgggttgactccatgtctttgctactgtgaatagtgctgcaatgaatatatgcatgcatgtatctttataatagaacaatttatatttcattgggtatatacccagtaatgggattgctgggtcaaatggtatttctggttctaggtctttgaggaaacaccacactgtcttccacaatggttaaactaatttacattcccaccaacactgtaaaagcgttcctattggtccacaacctccccagcatctgttgtttcttgactttttaataatcactattttgactgttgtgagatggtatctcactgtggtttttatttgcatttctctaatgatcaatgatgttgagcttttcttcatatgtttgttggctgtgtaaatgtcttcttttgagaagtgtctgttcatgtccttcgtccactttttaatggggttgttttttcctcgtaaatttgtttaagtttctcatagattctggatattaggcctttgtcagatggagagattgcaaaaattttctcccattctgtaggttgtctgttcagactgatgatagtttcttttgctgtgcagaagctctttagtttaattagatcccttttgtcaattttttgcttttgtttcaattgttaccaaaaaagagcccatatagccaacataaccctaagcaaaaagaacaaagctgggggcatcatgctacctgacttcaaactatactacaaggctacagtaaccaaaacagcttagtactggtacaaaaacagacacacagaccaatgaaacagaatagaggactcagaaataagattgcatgtctataaccatctgatcttccacaaatctgacaaaaacaagcaatggggaaaggattccctgtttaataaatggtgctgggagaactggctagccatatgcagaaaattgaatctggacctcttccttacaccttatacaaaaattaactcaagatggattaaagacttaatgtaaaatcccaaactataaaaacctagaggaaaacctaggcaataccattcaggacatagacaagggcaaaaatttcatgttgatgctgtgtttttttatgtatataaggttttatgattttacttttaccattgtaaaatatgattagcttgtctcattcatcttttttttctggtattacaatgggtttcacagtgttggttcaatgcctgccttttgttaaaatttgcccaatttacttttaccatcattttattattatactttatattgtcgaatttttaactttctcactttcacacaacatatagctagatatgggattgttgttcatttgttttctcttctttctttttttttcttcttttctctccctaatgttaaagcctctgatttataaggaaatataactcatgtttattatgcctacaaacatacttagtatttcttaggttgagattcccagcaagtggagcctgtggcaaaggctggtgtgcttctgctccattagagtgtgatcccagggagaagtagtgagatcaagtacagcaaagcagggaagaagggagagccaatagaaaatgtgccatggggctgagcattacaaggtaaagcagatgtttgaccttcaggatctcttcccccagaagctatatgactgtggctcagaaccgtgtgcccaaaggagacagagaggataatttatctacacacatctgttgcccatcactcaaaagtctggctgatagggggttaattctgccccaccacccacccctacacacacatatttcggttggacataggtgggcactgacgtagattctttgcttcctgtacttatatgtgaatagcaaagtgttgagaactggaagcatgagtgagtgacatgcaaggaactgacattgaagtaagattctgtgagggtgaggttgcatttgtagaaagtggttatagtccacttagcaatggtcatcacagaggtggctgagggaccagtagatggttctgaaaaggtaagtggatgctacctaggtttgtttagtcttctttctagcagggtttctgattgggtttcatttattttattctcttgtactgaattgtcttttcctatttttcttttttgttttaagcattattcatcataggcctaatagttgcccacatatatttaatgtgtatgtttatattataatttttgaaggataatttgaattattatccatttagaaaatgaccataacatactttcacatttcttgtgctctaccttcttcacctcaactagtcaccctttatatgctctgggtttcatattgaaaatatatttgaaatattcctggatcattacacataactctgtaacatatttattttttaaattctggagaaatctatttttgagctcactagtttcctttataagtctatccatttctcaattcaacccactcatagagttttttaattacttttttcaactaaaaattgaatgtttaaatctaactcttttaaaatgaccactgcttaacataaactgggaagagataagggagtcatggcccatctgttccagtaatcatccagatggacaaccaggtggcctctgccttgcttacaatcattaactgtgaacctggaggactgctacaaccaaccttagcagaagatctgaggatacaaaagtttagggcaccagtttcttatgttcttttttttctttataattcttttaatcttctctttatgtttcagggattcctcaaaatttgcaattggttgatggcactcttcatctttctgatgttcatttagaagtggtatgtgtgcgtgtgtatgtgtgtgtagtgtgtatgtagtcattcttaccagtagtgcacacctccccccccaattctctcctctatcctactttgttcttttgatttttttcatttcaagggattttggaaagtagaagagtaaaattgtatagtcaatctacaccctttgatacaatctccagtgcactaattaattttacatttttatcattgttagtttttattgaaacacgcatgccaaaagaaaaaaaatccacccaagaataattgaattggtgtatctgagtttggtagataatcctttaaatcttaaattgtgttaatctcagcatttgcagagctattgcctgctatcctgtagtgaacccagtttctaaatcagagcaatccttaattaaaatgggacattaatcaacagcaaactatttgcatctaccattattctaaattgtgtgacttgacaagatccacgttattgcctaagataaacattaaatatataaacttcataaggcagaagctgtttatcttagtcttatctagaaaagacattacaaataaggattcattaacttattcattttatatatatgtatgtttttcacgttatagatacgtatattattctttgccaattatattgtaattatatgctttaggattaaataacagttgtaattttttgtcacacacatgcctgcatgtgtaggcactttatgcatatgaacacatttatatttcttatttatacatcaagattatgcaaaaaaatgagaaaaaataaaaatatgaaaatgcttaattcagttatttgtgcaacctaaatataaaattagagcatgcctccaggatctaatgggagtcttaagggtccattagatggcacaattggtttaaaattataatatctctcaaatttttaaaattaaaatttgccttcaatgtaaagcaatggtaacaacaaactgttagaataacatatggcactaaccaaattgattctaaatggccacctgtccctaatatctatgatttcctccacagataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttcagcatacaatgtgatgttttaatatacatcttcattgattaccacagttgtgcttattaacatatccatcacctcacaggtttacatattttttttgtggtgagaacatttaagaatactctctgagtaaatgttaagtatacggtacagtataattaatgataggtatggtctattggatttccaaaactaattcattctgcataactgcaactttatgtcattttaccaatgtctcctcttttccctcactctcaagacactggcaatcatcatttttctctctgtttctatgagtttaagtttttaagattgtatatgtgagagtatgctgtatttgtctttctgtccctagcttatttcctttaacataatgttttctatggtcatccatgttgttgcaaatgacagaatgtccttttttttgtttgtttgtttttgtttttgttttgagacggagtctggctctgtcgcccaggctggagtgcggtggcgccatctctgctcactgcaagctccgcctcccgggttcccgccattctcctgcctcagcctcccgagtagctgggactacaggcgcccgccaccacgcccggctaattttttgtattttttgatagagacggggtttcaccgtgttagccaggatggtttcgatctcctgacctcgtgatccccccgcctcggcctcccaaagtgctgggatcacaggcgtgagccaccgcgcccagccagaatttcctctttttaaaaaaagaaaaatggccgggcgcggtggctcacgcctttgatcccaacactttgggaagtcgaggcagggggatcacgaggtcaggagatggagaccatcctggctaacacggtgaaaccccgtctctactaaaaatacaaaaaattagccgggcgtggtggcgggcgcctgtagtcccagctactcgggaggctgaggcaggagaatggctgatcccgggaggcggagcttgcagtgagctgagatcctgcaactgcactccagcctgggcgacacagcaagactctgtctcaaaaaaaaaaaaaaaaaaagaaaaaaaagaaaaatattcctgtgtgggtgtgtgggggtgtgtgggggtgtgtgtttttgtgtctgtgtattttctttgtctattcatctgtctatgaaaacagttgattccgtatcttggccattgtgaataatgctgcagtgaacacaggaatgcagatatctcttcaacatactgattttatttcctttgaatgtatacacaatattgggattgctggattatatgataattatttttaattttttaagaacctccatactgtttttataatagctgtaacaatttacaatcccaccaagaatgtacacgggtttccattttttcacaccctcaccaacactgattatcttttgtctttttgataatagccattctagccattctaacaggtgtgaggttattgtggttttaatttgcatttccctgatgattagtaatgttcagctttttttttttcatgtacctattggccacttatatgtcttcttttgagaactgtctcttccgatcctttgcccattttttaattaggttatttgtttttgctgttgagatctttgaattccttatatgttttggatattaatctctcattgtatatatggcttgcaaacaatttctcccatgtaggttgcctcttcattatgctaattatttcctttgttatacagaagctttttagttgatgcaatcccatttgtctatttttgattttgttgcctttgctttggggatcatatccaaaaattatttgcccagaccaatgtcaaaaggggttttttcctatgttgtctttcaataattttatagtttcagatgttacattgaagtctttaatctattttgggttgatttatgtagacagtgtgagataagggtacaatttcattcttctgcatttagataagcagttttcccaacatctttattgaaaagactttccccattgcatgttcttgtcatctttgtcgaagatctgttgacaataaatgtgtggatttatttctgggctctctatacaattccattgggctgtatgtctatttttatgccagtatcatgttgtttttattactatagctttgtagtatatttcaacatctggtagtatgatgccttcatcattgttcttgtcaggattacttttgactgtttggaacttttgtggtttcatatgctttaggatttcttttgtatttctgtaaataataccattggatttttatggggcttgcattgattctgtatttgttttgaatttttaacaatatagattcttccaatatataaacatagatttttttgtttatttgtgtcttcttcaatttctttcatcaatattttaaagtttaactgtacagatcttttatctcctttgctcaatctattcctaaatctgttttaaatgatactgtgaatgggattgcttccctattttcttttttgggtgtttcattgttagtgtatagaaatgccacagatttttatatgtttgttttgtatcctgcagttatacactgaagttgcttattagttctaacactttttcaatagagcctttaaagtttttccatatatacagtcatgccatctgcaaagagacaatttaactttttcagtcaagattgtaatggatatcctccagactgttcagttgtttccttacagaaatcacagttttaccctcagtaatctcaatacaattacaaagacaaataaaaggatcagtatgtctttgattttgttggaaatacattaactcagcttttactcagtttagcatagtggtaagatgtacaggttttgacattagacagatccaaattccaattctgcttcctcgaatcgcgtgctgatgaatttaggcatgttacttaacctctctgagaatctttcctttctttttttttttaatttggtgagtgagcataataatcacaataatcgaataggctatttttcaggtctatctatatatatatgtatacgtatataatatttatatgtatgtataaaacatttagcgtaaaagcattcaattgattttaatctccttacctgtaagtgtttattttggtgtgtattaacacattgtgtgtatgtttatatagtgtctgcatttaaataaaatagatttaaacttaataacctggaatgctagatttatatcatcacaatttattaggttaaaatgtgggtgctctaaaacaaacaaacacaatgcaacccctcaggctcatgaaagtaaaatgagaaatacattatgtggtgataagagctaatacttcatgcaaatgtgacattacacatctctttgtgtttaggactatgcttgtcagctatgcaaatgctagccattatttcttaacacactctggtccttaaatagcaccaagaggaatgttctatatttcactcatttagtacattattgtattgtaatttttaaataaaactaaaaagaactagaccacataaccatctttgatcaatgttcagaacaaatatatggcagagaattattaaacagtacctcaagcatgctctttccagagggcaatggattatttagtaccatgtcaaatcacataaactaattcaaaaatgataaattacaatgaaaatgcatgctgatgttttgtccctgaattctaataatgggtgtaaaacagtgttaactgtcattgatcagacacatttattggcatgctaacctaacaattaccatagtattgactatcaaacagccatatgattatagtatatgatgtactatatagtatatgattatagaaaagatatagcatatgggttcatttactctaggaataccaattataaatataagtaagtgtagaatactaatttgttaattaaataaatatcattttaattcacaacagttgacactctggttctccttgactccctgagttttaaataagaaaatgtattaactaacttagaattttctcaaatttatttatcattgcacttagccttcacctaataaaaatgtttatttggctttaggcgtgaaatttcccagatagtcaaaaacaaatctgccaaatcaatgccaataatcttctaagtattttgaatattaatatttatgaaggacaaaaggttacttttgtaatgttgcaattaaatgtctattttctcttcataaatagaaattaatgaatcaatgtttatgcaactgactgcttgccaattaaacacttatcttaggaattcataaacgtcctttctcttcaaagagtcagcaatagaaaattctttcttttttctcttttttataacctttcttctacctacttttttcttattctccctgcctatttcttgtcattctctttgttctatactcttttttctttgctctacatcctcctccacgtcccatgcagtgtatggtgttaactcatacaaagcagtgcatgtagagactatgttattaaaaccccaggggtttggtctaggttccattgctcactgcacagaaagccaatcactgagacaatgagtgttgcctgggaagagagatgggagccaaagctcaaatctatccctctcacccaagcaacattgggggtttatatatcagggaaggaatttagctatgtacagaaagcaatcatgacaaatgagggttctggcatctgtctggattcggtgatcaggtgagtttctgttccttccttgcctgaaggttaatttccctagggaggaactcagaagtgagtttcaagttttaagaccagaaggggcaatttctatatttatttaaaaaaaaaaaagtaaacatgagctctacggagcatttgggcttgtttcagcagtaggtgagggcgtggctgaggcctggcagggaagcgatgttcacaatgcctgatcaccttagtttaaaacatttagaagctgagaggaaatttcctggtcaataatctaggcacctcaaaaaagtttccattatttttttttcaaatacacagataatttcttggccaaatttcttggcaatgacactgaggcaagaccagaaatgaatggcttgaaagaatgagaacagcaaagaagaattgtccagttgttcaaatgagagaatttcagcccacagttgaggtaatgatagcagatctggaaaagacagggacgatagaggaaactataaagaagagggacactgtagaattcagcaataggttgaagaaaagacagaaatgagtcacagattggaaatggaataaatgcacattgatgccttccttccccactgttttttttaaaaagcacatatatcacctgatggttatctgaacgagagcccgactgaagaggctgacaatcagactaagccaagcagacaagtaaaatagctatagggaacagtcctagaaacaggttttacagtttagcatagatatgtcttttttcttaaaagaaacaatcttggcttatattttattcataaaagctattctttactctgttgccttgagtgattttgcctatgtgtagatgtgagtacagcagctttaaattcacctgtgcccttgaaacagcagcctgtagtacattcaacatcgttgcactgactgctgctattctgccttctttgtgagccaattatgaatctatcttcagaaaattgtgctccagtgctattactgaattaacactttgcttaagtgtgttaattcacagacacccacatgtgtgcctacatacaacctcagagaaaatgtgtaaataagtttaagagtagcaaaaaggcatgctttttatgaaaagcatttaaagtgtctaaaattttctatttatcctgttaagagagaagggtgcagggatttattaatattgaatgaaatgatgtatattgaatagaaaatatattttctttttttttgagacagagtctcagtctgtcacccaggctggagtgcagtggtgtgatctcagctcactgcatcctccatctcctgggttcaagcaattctcctacctcagcctcccaagtagctgggtttacaggtgcccaccaccatacccagctaatttttgcatttttaggagagatggggtttcaccctgttggccaggctggtctcgaacttctaacctcaggtgatccacccacttcagcctcccaaagtgctgggattacaggcttgagccactgcgcccagccagattatattttctttaagatagaaatagtaggcataatcttcctgatcttcctgattttgtcttccatgttaaagaacatttattgtctgtctaaaatttaatgttcatgtgtacatggaatttaaagacaaaagaatacattccgaagaaaaacttaacttgtatttccaagtcctatctttacatcagaacaccctgtagagctttaaaagttctaaaacctgaattccaccttgagaagttatgtttttaaaatccccactggtcaattgcatgcatagccaaagtggaggatccctgtattagggcctgcctgtcgctaggcgcagggggtggcagcagggcacagtggaggtgggtgtgtggtggaaatcacttccaaacttacctagctctaagatgggctgttagagggcagttccttctaaactttaaatctgaaatcaactgttcagtttatgattctgttactgtataaccctgaccttgaatttatctgggtcacctttgctttgagaaaacagcctgtctagaagagcagggattttgtaatcagagatttgaactgaagtcttggctctggccatttactactgagatacttaggtaaattactgaatctcttgtaacatctgtttcctcactctataaagtagagtgattaaaaatatactcaacagttccaaggctgttcaagttcaatgaaagataatctgtgtaggattgaacacacaggaagtgctcagtgtgcgttaatttctttctcctttactgaatggtagcttttttatactcatttgtgctccttataaaataggcaaagttaagggaaagtgattaaaatcacatgagcctgttctctatttggctgtatctctgtaaagagtgagaagaaggttggctgttttaatttttaagacagaaaaatgattttttgattttgttttgatagagtcttgctctgttttcctggctggagtgcagtggtgcaatcatagctcagtataaccttgaactcctggattcaaatgatcctcctgccttagcttccctagtcgcttggactacaggcacacaataccatacccagataacttttttaaaattttttttcagaaataaggaatctgcccaggctggtctcaaactcctgacctcaagcaatcctcctgcctcaacctcccaaagtgctgggactacaggtgtaactaccaaaaacggcagggaaatgatttttttaaacacacatagcaaaatgtttttgtcttaatatgtgatgcccaacttaaaatagttacctttaagagctgagaggttattccaaagatgctgcactgaaaaaaacattcatagccacacgtatgaaattgtcttccagaatttagggtacgtgaagcaggatggaaatgcaatcgcaaggtcctagggatacaaacctgggacaaacaagcaagtttcctgactctatagaatttacctttcagaggtagacagatgttgatcaagtgctcctacagaaaactaggacatgtaaaataactaaggatgggaggggagcaaatgtagaaaatggtaaaccatttcgaaggtaatgagggttgtccggggaaagagatgatgacaccctggactaggtttgggtgctggagtcaacttatgtaaattatttaggagggagagccaacaggatttgcatatcatggggatttctgcatgtattattttagaggtgaaatcaatgggacttgaaagagaagcttatatgtgatatatctgacttgagcaaccagatgaaccatgctgctagtcaataaaattggcaggattaaataaatctcttatatgaggtagaagaccacatcttgaatacattgagtttgagatgcctttggaccatccaagatgaaatgtcggataagcagcaggagcgatgccttggtcccacagacaagagagtgagaagcagttatacgtgggtcatggtataaatcatatgatggccagtgaagccatgagtgtgggaggtcatattcagtgaaagctcagagtgagaagagtgcctttacacaagtttttattaaggacttcctgtgatagcattgactgctgatcacattggtgtttgcataaaatagcataatctaatccacaaattctctttcttagaagttgtttagaagtaaaagcaaagctgctcttcaataaatgtctcttgcacatactcagcaatcctagaagagaagccaaaagatacaatcagtatgtaaaggtacgatcagtgtgtaaagatacagtcagtgtgtaaagataggtcagtgcttagaatgatcgaggggaagtcccagatgaaaaatgttgaaggttgtctggccatgtcagtttcaaacccaaatgaatcctgagatttttatgccctatagaaatagttactcattaagattttatcaaaatagtctccttgaaaaaataattctcatgtttgtcagctgcagtgtgtaatctaaaatttaattagagattttaaatatctcttgaatctctgatagcagttttcaagacatttgaggcttattagctcagcccattttactgcagggaagaatgagatagcaatggtgaactttttttttttttttaatgttaggcaactccttttattccataatgagaaaacacctgctttttaattaaaattctatttctgtatacctttgtttgagtagttgaatcctaaatattcaggggcagtgagtccatttaaaactcataacaagtaaaacttcttaaatttaattgtacccttcaggttcaaaagtgctttggtaatttgggttctaaacagaatgtgggaagcaattaagggaggctgctattgtgaatcatgcatcacactcagaatcgaaagacgtgggttttcattcaccctgtgctacacacaggatatgtttatgagctgagctctgtggaagcagagacatttcttaacctcccaatctccacatctaccttataaagatttggtaggttttgttgtttctgttgttgttgaagttttaaagtttatggtgaaatatatgtcagacattcaggtaagaataaaatattataaaaagtattataataaacattaggtttctttaagctaacattaggaagtaattacttcagtttattttttaaggaattaaatgctataaacacaattgagatcctttttctacctttctcccatatcatttccttccctcctcctccactatacatacaattaggaattcagtgcacataaaaatatttttttttagactgaaggactcctagatccttatctatgactatagagaaacagatcagagagtgtgctaaatctataggtgctggccctgtatatgtcaaaaggataataatttctataaatgtattctgtacttttgttacataattatgtattgataagtatatgtaattttttgcactatgtgttaacgtttatcgaaatagcactacgtgtacattacactacatgtaacattgaacctcttgcttttttactcaatatttttttgagttttctctatgttggtaaaggttactaattcattccaagttctacatcatattattccatttacaaatgtagcataatatagtcttccatattcctgctgatggatgttagattgtttataatgttaaattgttcattataaataatgaagtaatgagcattactgctcttgaacatgccttgtgttcatatgtgagagttttatacacaggatatttctttcttgctgtagactaaaattgttcacttttactatcacactgctatattgttttccaaagtggttgtacaaatttacacttccaatagcagtgtatgagagtcttatttttccatatttctgcaaatatctagtttttccttttttgtatgtgtgcctgaatttatctcagactttcatagctaaatttttggggccacctctactgtcactactaacatctccatgaatgccaccatctccctgattctttccatgcgagcattgtatataggtgcaatggaatgggccaagtgctatttgtaatcatggcagctgtcgtctaatatataactctatataatcaaaataacatgagtaaaatctttaatctgtcttattcattcattatatgttagttaaatgttggcactaagaataattataattctgatttaataattaaaaagataaaagaattatataattttttatgagaacacaccagattcaccatgaacttcaaagagggatacataaaattctgcccttgtgtggatcaaatacatgacatctaacctcaccggaaaactggaaaattagtcaaaatagcaaataattatgtagcttcttccatcccctctttgacattccctaatttcacataattctagaattaaaaggaatacagtaacaaccttgcctaagtttcttatttaaaattcaggaagaatattctcaaattatgaatcctaaagaggtgaaatgccttgataaagtcacataacaacagattttcacctttaacttctttttcctgatttttggcagcctgagaccctgcagtgcagtgttctgccaaaacacgtgggcctgttgccctcaagaacagcccaagccatcaagatttccctgactcacttgtttactctaacatctcacctcctttttctgtaatatttcaggactttcctccttgctaaccaatctaataagctaatgagccagcactggcagaggtttaatgttctatccattctcaataatattgcccaagagggaaatttttcagccagtttctgttgaagcctctcaaaatattactctacaactatcaacctaatcttctcaaatgtaggcagaaaaacaaaaatcacttcagtcttttctattttaatttactgaggtacactaaagaaaacttctctatcattatccacctcataaaggcctgagacaatcacactcatcacttaaattcagacataagcatggcacgctaatgaaactaaggcaaatatgaaggtaacagtttatttttaatgcctattaaatattgttaaattaaaatgaaacatttaagaaaatatatgtgacattcaaatgaacaccaaatgattcatttcacactagtcaatattaaattaactccatattacatgaaaatgttaaatactactgaaataagcagcaaaagaaaattatactgtaacctcacaaacacatcatggttggaaatttgttattcaaaaaagattaagactaattttgtaaaactgttttaaagtcaattatttttaaaaagaattacgagaaaatatcatcacatcagtggttccattatatgttttaaattaatgaactaatgaaacccactaaaatgtaggcaggtgtaaacaaattgctgtttgtataacgcaatacttagtaaagattatttaagtagtatgctaaaatctaaacaatacgtagagtctataaaggataacttttagaattacgtttcaaaattaaagttgaaataataaactgaagaaattgctaacctaatcaattctgagtttgcaatatacaacacgggattggtcacctgatatcaatatgtaagttgtttcaaagtgcaaacttgattttaaaaagtttctttggtcttcatattaaagacatatttaagtatcacagataaattactcaagttatcagttaaattgctcaaagagtaacaccataattactatacaataatattttgattattttgacctctataatcatgctgaagagatatttataggttcttgattaatgggcaattttttgatttagattaattctatgataaacttaaggttatcaagtcttattttttcttcaataatttaacattcacacacagacacacacacttgagtccacgcttgagtgcccactctacaccgtgctgggactcagaaataagaaatcctcggccgggcgcggtggctcacgcctgtaatcccagcactttggggcgctgaggcgggtggatcgtgaggtcaggagatcgagaccatcctggctaacgcggtgaaaccccgtctctactaaaaacacaaaacattagccggacgtggtggcgggcacctgtaatccaagctactcaggaggctgaggcaggaggatggcgtgaacccgggaggcggagcttgcagtgagctgcactccagcctgggcgacagagccagactccgtctcaaaaaacaaaaaaaaagaaaaaaagaaaatccttaaaaaaatcagagattaacggggatgacagacaaactaggacacagtgttgcctgctatgcatgggaacgttagcagaacactctgggaggcccagaggaacagtgtatattggatttggggtggcatcactttctcaggggagtgttgtgtggattgagtcttcagggactagtacttgccagctagacaaattggtgcatactggggctggagaagcagcccatgggaccacaggaaaagcagcagcagctggtgcactgcactctggaaactatactacccaaggtcagtcatgagatgagcttgatgaagtgagagagaagtgtctagaggaagggtcagtactaaatcgcaaaggcctcacatcatgatgagtgactgcagcttgatgaacagatagagaagtctgcaaaaaaaggtcaacagagaaatggcgttatcagattgattttccagaaagctcctactagttgcctcattgttgttgaatatttcctacaattggaaacattaagggcacataaggagaggctttgtgatgatggcccaaggctttacctgggattgaccatagaaggaagggtcagaggctatgctatatttatggctaacagccttgtatatctttttttttagatggagtcttgctcttatagccaaggctggaatgcagtggtgccatcttggctcactgcaacctctgcctccggggttcaagcgattctcctgcctcagccttccaagtagctgggattacaggcacccatcaccaagcctggctaatttctgtgttcttagtagagacagggtttcactatattggccaggctgatcgtgaactcctgaccttaagtgatcagcccaccttgaactcccaaagtcctgggattacaggcatgatccaccgtgcctggccaccctgtatatcttaaactagaacaataaagtgaaggatgtaacttttttttgtttggttatttcttccttgtaagcttggacacaaactaaaatggctcatgagtacagctggaagttaactcaagttagaggtctgcaaattatggcccctggactacacctagtccactatcttattctgtaaatagagttttgtcggaaacaacccagtcacattaaaaccaaagcttattcttctatgaattgtctgtggctgattttgtacaacagcagaaaatcacaaaagagaccataaggcatgcaaagaagaaaatacagtctagccccatatagataaagcttgccaacccttcatttaagagatcactcagtgcagatcgtgtattttttcccacatatttccatcttttttgctctttattgtttcttacaccttagatgcacctggaatcattttctctctgtctacagttcatctcttagaatgactttagtgaaagttgtcacaaagacccctctcaacattgttgctctgaaaaagtccgtttttatcagcattcctgaaatgttctctagattataatcattctcttttagtgcattaaagagattattccactattgactgtctgactttgttgctgttgagaagttagccatcagtcaaattcttgctcctttgagggtgatattttgttgctgttcttcacctgtggcctttcttaagatttttttctcagtctttttttcccccagcagtttcaatgtaacatatttagttgcagatttctttttaattatcttgcatgggatttgtgagcttcttgaatctgcagattactgtctttcagatctagaaaattgtcaatcacaatcttttcagatatatcagctgtcctccagtctctcctctccatctgggactcggattacatttcctaaatcttgtgttggtgtcattcatggttagtaatctctctcatgtatagtccatcatgggtcttttaaaattaaactcaagataattgtttgcaagctatcttctcagatacaaagtctgtctttagctgtcttcagtttgttgttaagtctgctcacagagatcttaatttctatgatatatttttccagaagattttttaaaccttctatgtctgtttctatggttccctgtcctctgcagatatcttttagttggtccttcatttatttacacctttcagtgtagttgttttataatcagtatctaattacttattaataaatatctgatgtctttaccttttgctgtggttccgttttccatttctgtccttttctacttgttctcatagtctagcaccttgttgtcatttttgacatgatgaatattctttttgaaaaaaaaaatttagaactaattgacaaacatttttcaaagagaatgttcattgctgcatcaagttcaagacgtggtacagaaaatacatgactaattctaccgaggttctaccacttccattcaccctttgcctgagggcaaactctttagggtctcagtttatcaagaaggagtcttattagacttccaattttaggtgaattctgcattagattttgattccattcccagaaggcctctgctaggaaatcaaataccttcagggaaaaatccgcttttgtaccaagataaatttccaagttttcattattccttcttttcaggcctcaaaatgtcttattgtcttgttgtctgtgtgatgcttttaagaaattattttgtaatatttttatcagcttttttagttgttttcaacaggccagaatgtccctgtaagcagaccctcccattactataaacagtaagccttctgaacaggcattttaacagtaagagtattaggttaagtaaggtcttaaataaaaaccttcctgctaaggtctttgcttcctctgctgcctttgtgagccaaggggaggtttctcactctttaaaactcctgtgggcttaaaggaaggtagccaggcttcgtgctcttttagctccaaactggtacaaagtctgtgttaaaatagccagtcgaggccatttttgtctacatggaactatggttatggcatgtaaccagaatgctaaaaactctttgctggtaacattgtagactgcaaaaatggcaacttggcagctttttgaaaaatgatgtggagtcgatttcttcaccctttcattctggactgctttgcatattacttggttaatacaatgctacagaaaggatgttggatataatctgagtagtctcaagaattttgaggtatatccactcttacttttggaactctgtgaacttcacatctaataaattactggacgatttgagtccatatggaaaggtgccctactcattccagccagtgaacctaccagctaactacagatgcatgagcaatctctctttagatcaactgagaggaaccagtgtggcccagactagaaccactcagtgaaattcacaccagattgccaacctaggaattcgtgagctaaataactggttattgttttaagctactaaatgtagaagaggttaggtttgcagaaaaactcaacacctagagctatattactttatttaaattgttcttcttaaaattaaatctctctcagttatcaaatcaatgagcatttttcagtccttatctaatgagactattttacagtatctgacagtattgattattcgtaaacaatctatactcttttagtgtctatgacactggatctttgtgcttctgctggaatttctgtactattcattcttcatttcccttgtagattttatttcttcttgttttccttataagtatcagcatttgttaggtttccgtctttttcttatgtttccatccacaaactctccctgttggatctcctccacttttttttctatttcaatgaccactttgtataaagatataaattatgtctttatgcaaagcctcttcctgcattaaagtcctgaatatataatctgacagttaggtaatagtcagatatatgtcccgaggccctatgcttcaacatatcccaaagtatgtaactgcgttcttctctgccatctgctggctggctattcctctatttcacatagtatcacaactagtcacccagcaacctactagagaaacctggcataacacatgcctccctcctcattatatttgtgtccactctgtttctctcgcactgctctagtttaggccttccttctctctcttttgaaacattatgatcgtttcttgactagtatccttagctgtagtttgtttctcttatatctattctaaacttagctgtcaaaaaagttattaaacaacaactttcagagcatttgctacagtgaatttggcaaataataaacatatttgctaccacaatttttgtctctgcctctgaaagttatcactaagtgatttctgcaagattttcatggtagcatccaactacacagccagccattgctattggataggagatagctttaaacctgaaatctgtttgccttaggattgtcaaagattaacaaagcgggacagtagttaacatggcagggatatattttaatcagtaatatactactgcaataaggaagaggatctagttctatcacaaacacctcttctaacatccaggttagttttctttcaggtgtctttgtatgaaacatctagagtgggttaggggctatacctttgtgatcctgtcaaacctatatgacatcctatcaatatgaatacgaaacctatatgaatccctattaatatacctgctcacaattttgaggttttctgatgatatttctatttatttcacttggactctgtgaagtcaagtactgtatcttaaatatttttatatccccatcatttagcacagtacgtgacaattaaaatcagtcagtgattttaaaatttaacaacaacaaaaacacataataatgcgctgacctcctacaactctaatagtgcttgtgggctcaacattatctgaaaattgttcatttagccagaattatgatttcaaaataactaaggactataggcaactcattctattgcctcagggaaacgtccaaggtgtcctacttttgtggacatgtgtcatctgacaaaaggttgtcaagttcactgttctttccagttctgcctggtactatgattgcagtgcctaagcagcttgaatttcctgggcaagtgtgcaccatgctgtaataattcagaagctgtttttgtgttcttgaaacatatggtgctagctcagatttatcttgggaaaagctggtcaggaagagaaactgctgaagagctgaaatctctcccagcagctaagaaaacaacggagggacactggcgtccttcctccgagagctcaggctctccgccagtttgtggtccatatgctgaatccagagagctgcttcacttctaataacgattgtgttaagttgtgtgaggctgatattcctccagagggctcacagtttcaagcatacctaaaagcacctgttaggaagcagagcctcagaaaaatgcattagcatttctaggaaaagggcttatttttattcttcttggttacagagttgcaagttggcttgttcagaaagagctgtttttgcaccacactgatgttcagtttggtgcaacatttaagtctgggaagagcacagagccaaatgtggcaagagatggcaatagagaaaatgccaagtgccccctggcttatctcttgtagaagaatttgtagcaaggcttagaccacctgaaatgaatagcattctgcagttctgtctgaatttcactctgtgatttattatttcattatactagactgaatttgaaccaacaaatagttcacccagggaataaaatatacctttactttacagatcctttcccttcccttcccatatctttttcttctttctgtcccacctccaccaatgtgtgtatgtgtatgtgtgagcacgtgtgtgtgtgtgtactcacatccattctaattactggaaacctacctttgctggagcaggttaaatattgcctcttaaatattagtatgtttagaaagcccattcctataataaaagtggtcatttctacccagttgttcccaaatttcaataaattaatctgaataaatgagtttatagatattacacttagaaaatgcatagttaaaaggaaacattttaataaaataacacttttgaaaaagccaaatttcaaactggaaaatcagaagcaggtagtggccagtgccactagaacatgttaggaaatctcaaagtttcccctccccctttaaaaaacagtgttcctcagaaaaagtatacatatctcatttaactcagcctttttagcccagtcctattatagtgctgtttgttccaaactgttttataaaatatgtttatgctaaaatatgtaatattaccttccactaaataaataaatatattgtacacacatcacatacatatgtgccatcaccaactcctatatgaggactaaagctctgattttttatcttggccaaattcctacctaaggggtgtcgggagtcatgccctgcaaaccacaaattctcatcaggtgggtaccctatatatcgtgacttactttccaatctgactctggcataacattatgagacaaggaagaaaatcaaaatatttcaccccaaaacatgtttttctgccatgtcttggaatggccctacaaagccatcctttgttgggaaagatctgcatctgtaaagaatctctgttaacatagctagatctttttctttcaggccctcccaattctgaagagattaactaaaagtctagcaccttttaaagatctgaataggaaacatttgtcatctattgtctctaactgcagccactataagatttcaaaagaactttggtctctacgatcttttatcttaacccgaatatttcttttctatccatctcaggtctttagacaaactcaacccattgtcaaccagaaaatgtttaaatttacccatagcctggaagccaccccccaacccctccctgcttagagagttgtcctgcctttctgaaccaaatcaatgtatttcttttttttttttttttttttgtgacggagtctcccaggctgtcacccaggctggagtgtagtggcgccatctcggctcactgcaagctccgccttccgggttcacaccattctcctgcctcagcctccccagtagctgggactacaggcgcccaccactatgcctggctaattttttgtatttttagtagagacagggtttcaccgtgttatccaggaaggtctcgatctcctgacctcatgacctgctcgcctcggcctcccaaagtgctgggattagggcgtgagccaccgtgcccagccaaatcaatgtatttcttaaatgtatttaattgatgtctcctgcctccctaaaatatataaaaccaagttgtaccccaataaccttgggcacatgtcaggacctcctgagagctgtgtcatgggccgtggtcactcatatttgtctcagaataaatctcttcaaatattttacagggcttgactattttcgtcaacatatactataatatcttccaaaatgtggtcttaactcacgagagcaaacagtgcagagtgtgtgatattttctaattccatgagtattagctggttgcaaaacaagcattctcagcccatggcactgtgtattccaagtcgagcgtattctttaatgtgtttttattttgcttcactctctcatgttaccatttatctcatcttatggtaaagcagttttgatccataatggtatttttaaaagctaaattttccaaactgaaacacctagctgagtaggccgcgagttaaaagagtagtgtggcaatggctgtagattccttcaaggaagtggttgaaggaagggatggattttagggattggttgaagtcctttaatattttcttcagcataaaaaactgactaaatcaattagtacaaatactttccagagcagtggtccttaaactctagcatgcatcagaatcacatggcaggtgactgaaaccacagattgctggccccacctttagggtttctatttaggaagtcaaggtcgtgacctgagactatgtctttctttttctttctttcttttcttttcttttcttttttttttttttttttgacagagtttcactcttgttgcccaggctagagttgcacaggctggagtgcaattggcccaatctcggctcaccgcaacctctgcctcccgggttcaagcgattctcctgcctcagcctctcgagtagctgggattacaggcatgcatcaccacgcccagctaattttgtatttttagtagagatgggggtttctccatgttggtcagtctggtctcaaactcatgacctcaggtcatctgcccacctcggcctcccaaagtgctgggattacaggcatgagtcaccgcacccagccaactctgcctttctaacaagttctcaagttatgcagatgctgtcaggtggtgtcttggttgatttgagccgctgtaacaaaataccatagacttggtggcttataaacacagacctttatttttcacagttctagaggctgggaagcctgggaagtttaagatgaaggctccagaaaattcagtgtctggggagagccctcttcttggtttatagatggtgctttttagctgtgtcctcacacggtggaaggagagacctagctttctccagcctcttttataagggcactaatcccattcatgagggctccactctcatgacctaatcacctcctaaaggccttgcctcctaacaccatcaccttgggtgttagaatttccatatataaattgttaagggacacaaacattcagaccatagcagcaggagggaacacactttgatagctgttcttctagagaaatgtctatagtgcttttcagtctggatttcataagggttactatggtattatctgagaaaaacaaaaatggtgctacctagctaacttccacagaaaaaaatcaaaaacaacttttctttttttcttttattttctcctttttctttgagagacggggtcttgctgggtcacccaggctagaatgcagtggcctgatcatggctcacagcagccttgacctcctgggatcaagggatcctcccacctcagcctcagctgggaatacacatgggcatcaccatgcctgattgatttttttaaaattatctgtagagacaggatctcactgtgttgcccaggctggtctcaaattcctggcctcaagcaaccctcctaccttggcctcccaaagtgccgggattaggattacagctgtgagccactgtgcctgacaaaaaaaaaaaaaaaaaaaccaaaaaacaaaaaaaaccttaaaactaaacaattttttaaaaaatataatgaatttatattaattttatgtttcttttccactgagaaattaggaaaatgtttagtgaacttttagccacatttaactaggaaaaaaacttcttaattttggcctgaattcctggctacagctgactgaccatcccttgacttccacaacctttattgccatcccaggttggcccctcatcctcagagtaacatcctggagagctgtcatcatccaagcttgcctcatatcttctgtcctaaatttttatgcgccaccttctgcccgcaaacttcttgacatcttcagcctgatttcctcttttccttttttttcctcttttatccatttctcagttcattctcttctgctttcattgtttttctgaacatacctagacctcatggtcaatcatcgcattgatcatttctttctaatattagaaatgtcctgactttcttgccattattcttacacacagtcagaataatccaatctaatcattcttttctctttgacttccacataacaatcattgctaggaaaattaatggttagactgccattggaatttccaactgcaaaatgtcctgtctccaagactagatgagcagtaattggacatatccctaatgagcactctgccgttttccacaatgtttatttcggattgtcatcactgaagtccctttctcactaccctctctatcacactttggaaaaagatctttcctcccatactgtacaaataaaataataataatagccaccaatcattttttcccttcaactttcttcacccttccctatcctgctacttgcggattcactcatctgtgcctcattgtttcctgcttcagaagaacacaagagcagaatcaagagccagcacaaacatagttttggaaaagtgcccgattttactttccatattttatcaccagtgtagtgtatgaaaaagtagggaacatttaaaagttcagaaacaagggctgatccattgcagtctgcactttcatgttccatgaaaaccaaaaaatcaaaaaactcactctattgaaatcatctctttcctggtttatctcttaaactaggaaatagttggttcctaggaaatagttggttaaactaggaatagtttggttccctgtgactcttgcctttcatatctatgtctacagcaactcagtatctagtacatcacagggactgcccagtaaatgattcagtgggtcattccttttttttttttcatgtctaatttttgttgatcctcactttgtgatccacaattattcccttttatttttctcttcttgagtgtcacatttgtgttatgttttatttgcttatctattttgacaaatgttcacatctttttaaaatatacatatgtatgagacataaaagtgcaaagaagaattctactcaaccagaagtaacccttgctagtgtgcatttatcatacgacattctggacaaggctctgtgcatatttaaaatgtgtagtccctgggtattcttctggtttctttctgttattacctctcttaatggggtgggaaggagtagataaaattctacctagagtagctatttgaagatgatgcttcaaatattatccccaagtggtgagggttttgtcagggatttggggaggggggtgaggggacttgcacttgcctcgggacagtctaaaattccaatttaggtttgtcatctcaaatacactctcacaagtctgctacgttctccaacttaggggcattgctctgtttagagtttggtttttgtaaaagttaaagaaagaggaaagaaacacaaaaagtggcttaacagtcaaagacaggtttattttggagaacaaacctgagaggggtttctggacgatttttttggtgaggagcactctctcttacggtctaagagtatttattggtgagagaggttggaaagtttctgtgttggggagaagtttatggtggggttggaatgtctctggttagagggcaggttatctggggtctgacatctctctggccggaggggagggttatctcagggctggcatgtctctggtcaggaaggggtttggaatgtttctggtcggagatgtcatttgtggtttatggtcatgctgaccttagccattaggctgataccgtttagatttaggtggtttttgatcaaggtgaactttaaaatggcagtgctcatccaagatggcaatgctcctgctctgtcagttttcagggtgggattgtgactcacaacaatgttctgtgatataaagagatggccattgctttcccaccctcctcattctcttatatccaaccatctccctgtgctaagaagccagatcaaggcaacaccaatggccctccagcaaggttccactgtacgacttcctctcctgttctaccttgtggatttgcatctaaaccttgtctggctcccttcatccctcagaccactttcacacttctaaacttcatccacattttccacagagtcatcacattgtcttttcagattcattcactcacttttagataagtctgtacttgtctgaagtctgaggacataaatatcagctttaatcatcctccatgattttgatccaaatttgagtatgtgatggagatcatttgagttttaggtttgaagttagtttttttgtttttttgttttccaccacataggaaaagttacactctcctcgccttctcccccctcaaccccaacatgtgtctatatgtttagtgacacttaagggaaaaaagtagaagaaaaatggcctagtgctgctatttttcattggccgtccgtcctaccaatttactttgaaatttgtttgaagaatgatgtactgaagaggaaagatgaacaacagcaaaaagtcccttgttagttatgctttgctcacggaagaccctcattttggtgtcctatgacctgcagttcagttccgtttctctcctctgagtgtccatgtttagcccacctgcctctgcattgggctttatagcctatttgttgttgagtagtgaggattacatcttgttagaaatgtaagctgaaaatagtcacagtggagctctagaatcaactttcttggcaaaagtgctaaatagtcatcttgactctggtaagccagggatactattactactaataaccattgcggcctactgagtgcacacaccgtgccaggtagtctgctaagggcttcagtgcattttaatcttttcaccagcccaggactctgttgttttttgtttttttcttaagtaaagaatttttaaaataaagaaactgaacctcagaaagcttagataatttgtgctagttcatcacactaataagtggtagactctctctgtttgactccaatgactatattcttgaacactatccaaatgaataccaaataactcactttgcaaacatttcatgtccattatcacctcattaatttgttcattttattgctcatttccagaatgctcttgccactccttttatcataaaacatcccatccattcttaaagagccagcttatatctaatcttgtatcttatccttcccctaattatccagcataaaatagtgtttctgcctctgttccccataagcgtgtctgttttaacacttatttttaatatatcagttaatgttagacatctatcacctttcggtctcagagttgtaccagttcccatctcctactgtatctggtaaaggacagctttttgttttgattttcagaacttgatttcaatatatatatatgaaaagaggggacaagataaaataaaaaaagtaacatttgatataataatgtctaagtcaaattctaggatttactaggtgtgttatattagaaaatgcaacagggatcactaaacctcaatattgtcttctgaagaaattatcttcataataaaactacttgttttacctttgattgagtttttaagagaaaagcaaatacaataataagtgatgaagtattataactcataatgtgctatgttactgtattttgtcgttgctgataaaaatagttgattgatgactttttaagtgacttttaggcagtctagagtgagcagtaaaagaaattaaagctgaaacagtgaacctaaaattctgttgtagaagttgttaataactgtcttttcttcagcagaagttacctagttctacattgcctctggctttttgccacccattaagataaaaagctagaagataggaactaggaaatagtagagataaggtgaaagtctagcttgaactcagtgaagcaaaccaaaataagcaaagatccctcacttggagatgtggtagaagacttgtgtgaattattacagtgactaactacacagaggaataaagttatacatataaagttaaaagatatgtaatatgagtgctcctgttgaatcagccaacatgaattcagtcatatagtcacaacagtgtgcatcataaaacagtatcataaatagcaatgagttataaatggaattgaccaatatacttagtgagaccaatatacttggtgagaaactacactgtgttattactttgtacaattataaaagataattgcccaatataaataataactaaaatttaagaagaaattttctatttttaatctagattataaaatgaatgatagttatgtaaagtttatctatttttctttggaaggaaaccaaatctggagacataataataatttggtatcatgtaatgcctaggaaatagtacatatctaataaatatttgttgagtgaataaatgaatgacagccactgtaataagttaaaaagtttttgtaggtaaaagacaaggctgaaacaatgattctgactcataagtggtgggccattaattatatacatatatgcagagacacacacataaactttaagaaaataaaattttaggaaaatagataaaatgtcaactagtattttattgttctgctaaatgaatttgttgtcattcatgacagtgtaatgattccatcttgtgtctttgtgtaggcacatgtgtgaaccactttaatccccctctttttaattttctaacattaaaaaaactatttttttgtgtccatgagacatacagtttcaaaattattttatgaaattgaatggatagtataggaattaatgtcatgtatatcacagtgtgattccttttaaaactgaatgagaggaagttaaggcatgcctactggttttcaggggcatctagtaactttgagttattaagtaatgaaatgtgagtgacggagttcaagttcctattaaacataaggagaaaaacattcatatagtaggtttaatcactgttactttacactttgatgtgcaaattaaaatcgagaacgtgtcatttaagtaggcttaagagttattcagaggtagaaatatgacagcagctgacctttattgttatattttactgcaacaaaagctctgtggatgttacgcagtttctagtgtgaattgtctgaaggtgataaaagaattcaaatatctggactgaggtatatattttaggagatagaaaaatcactttcttaccttcggcaaactttctcattgatcacaagagtcaaagggcaatcttcaatcctctaacttacatcacatggtaaactacttcctttgcaatccataaaatgaaaggtacaggtgatattctgcaaatacaataagaagattctgttgggttacgagcgtcttgtctgattaatttttacattccctggacctaaaataatacctgttttgaaacagtagctccatgagtatttaccgaggtcagcagaatttcattaactgaatttaaatgtagtaattgaattacccacacaagtaatttagtttgagtagttttacttagctaatagtggcaagcataacattaaaatgggcaaagaaataagcataccagagttctgcaagcattttctataaacagccagataataagtattttaacttacgagggtttaaaaataaaattaaggatattatgtaggtgcatacataacaatttaaaatgtaacaatttaaaaacaaaacaaaactatttgtaactcacaagccatacaaaaacagacaactggcactttggctagtgggctacagtttgcccttccctgaaacagatttttgtgcaataaattcaaagattttgttcccgtagttgacctaaataattctgtagatttggtcctccatgatgcaaatttacatagacaaggtgattagacagatgatggattgaaatcaatttcttgtgagttaaattaaacaattgaaatgaattgttttattatgcctttgtctctgcatataagttagcaaattctgggagccaagtggaaaatgtggataaaaggatttaagcatgtctggagcccctagggagaatggcatctttggaagaaaaaagttagtggagttcaaagtgtgccttagaaaaggatagatttagatagaagatctcatccctggtaacaggaggaaggtcatatgcagatgggctttgggaggagtgtgagggtgagttagttggagcaggtgagggcagtggagctcactctactaacctggcagaacactgtggtcctcaaggcctgatgtaagtgcatttagctctgggagacattagacacaagtaagatctattcaggaaaatgttattacttgttcccaaaaggaattctgcaattctgtttggttttttttttgttttttttttttgatacggagtctcactctgtctcccaggctggaatgcagtggcactatcttggctcactgcaacctctaccacttgggttcaaacagaaattctgcacttctaactgaacaaaatatgcaattaaatacacatgagcaatggaaataaattaactttagtcaattcatttctgtagttaaataacagtagtttatggaaaattagtattgccttatcaaaggagccaaaagccattttcaagactgtaaaacattttatatgtagtagtattaagtggtgtaatagtaaaatttaaaagaaaaacaaacaaacaaaaagaagatgagcaagcctcttgatctttctgaattttagcttcttcatgggtagggtgaagatgtgttacttaatgtttgccaatgtcttatctatctttacaatgccaagaagtcataaaatttttatgttaaatatctaaagtataaaattactctccaaactacccaaggtacacatgtatgtactcatgcaacacttagacccatagttcccaaactatgtgtcaaagtgccttagggagctttaggcttgtgggtcatacaatttcttacaaaataactcaactctgtagccctaaagcagacgtaaataatatgcaaacacatgagcatagctgtgttttgacaaagctttattttcaaaaagaagtggccaacacccaagctgtacttcactgaactctggtatacagtatatacatatatatttatatatgcacattaaatatatgcgttgatatgcgttcaagcaatgtacaaatatatgaagtttcctaattgatgaataaaatgataaacacataaatacttaagtgaagaatggagagaaggaagacagtaggtagattagagatagcctgagtcaaaaggaataaaagccactagtcagggaaaagagcttaatacattcatatacatatacacatacatatacacacagatgctcctcaattttacaatagggttttatcccaataaacccctcataatttgaacatatgatgggcttatcaggagagaaccccatcataaatcaagaagtatactaaatgcatacacttttgtaccattttaaagttggcaaatatatgttgaaccttcctaagttggaaaatggtctatctatacatgtatgtacttgtatatttgttctctgttcctctatgaaatattgatgacaaatttgttatttatttgtcgtaacagttcgtctcagatgtgatagatacacagtgtgtatgattatgaaacttgtaaaaagttttaagaataaataaatcaataaacatccatttcaatcctgatagtaatgaagtttaaactcatttccttggtactgtctcttaaaaatagtaataaaaggttttgcttgagcagaatgactgcctaatgtagacattacactcttgtgaaaataaccactttgataatacaaagatagccagtctggtagagattaaactgagacagctaagcacctgtgttgcagacattcagttggccatgttatcaagacccaagatattgtaacaaataaataaagtcatagtagtaataataataaagctaatcaggccaacagaatgccccccaaatttatttccacttaataaatgctcttctaacctcatattaaaaattgtgtctctgattccagttaaagaccaaattttaaaaatacagagactccaaatctgattctgtattgaattctaatgtgaagatctttgctggaatgcttcaaaggagattagaaatattgattatcatttaagtactcttagatcaccaaaatctcactaatgaagaatttctttatatcatgactgtgattggctagttaacaaactataaaatgaacatgtaatacattaatccctcaataacatgacctggaatccctacattctaaaaatatctctttgttttctgcctgtatttgacagaaatacggcattaatgaaatgttcagttcttgcttaaagtacataccggcataatttttcaaggaatgtagggcttcaacacttcttaaaagtcaagtttgactcttcctaggatagaatatagaggtatgattaggtaaccttaagtgagagagagattgcacgtagaaaataaagcttattctgccacctagaacagttttttgaatagtccttgttatgtctgaatcttgtcactcaggtctcagttgaaatactagctttctacagagatcactttttgatcactgttttaggaaggggtctttagaaattagattttgggacagaaatgggtatgtaggaagcttactggaaattgccttggaattaacacctgtagtggggtgaaggaacctggactggcagagaaatgtagtcaaaattaaggccacagcagattcatctttttcaccaggagctctggtgctggaatgcatctgtagaattattccaactttccccagaggagtaggcattcatgtccccatatcagtcagccattggatgagggatgggtgcacacgcatggttgtcttacctctccttggctgaggacaattcccagagcaaggctctgactgagagctttcagccaaaaacactcccagaagttgggggagtaacagcttcagtcctaatgagagaaatagatggtttaaaatggcatctgcaacattctactccctgcactattcagatacttgtgattcatatacagtcatgcatcccttaccaacagggatacattctgagaaatgggtccttatatgatttcatcattgtacgaacatcatagagcatacttacggaaacctagactgtatagcctactacacacctagggtatatggtatagtctactgctcctgggctacaaacctgtacgacatgttattgtattgaatattgtagtcaattgtcacacaatggtatttgtgaatctaaacattaaaaaaaaggtacagtaaaaattcagtactataatcttacggcaccaccattgtataggcggcccatcatttatcaaaacgtcattatgcggtgcatgagtgtattaagttctggaatcagctcctctagaatccctggaaaaacacaaaaaggacagtaaatgagacaaactacagcccatgcactatagctagtcagaagtcataaatgatattcattgtttctctcttccattatgatttctagattcacctttaactagtgcttctgaagatctgggtagctactaaatgcagaatgtcatatctgcagggtctgggttcttagtcatcataaacttctcaggccttacctgtttctcttgtccagttaccacaaaaatttagcaacagagaacaaagagatgcctcaagaatcaccaggtttaggccaggcacagtggctcatgcctgtaatcctagcactttgggaggccaaggcgggcggatcacttgaggtcaggagttcaaaaccagcctggccaagatggcaaaaccccatctctgctaaaaatacaaaaaaaaaaaaaaaagaaaaaaagaaaagaaaaatagctggacgtggtggtgggtgcctgtaatcccagctactcaggaggctgaggcaggagaatcacttgaacccaggaggcggaggttgctgcgagccaaggttgtgccactgcactccagcatgggcgacagaacaagactccatctaaacaacaacaaagaatcaccaggtttattatatgggggccatgcaaattcttccttgtccccattgtgaaacagcagccatactttctcccggtgatcaaggtagcatctccaggatgactatcactttatttgtctcctggagaactggtatgagaaggtccaagtgacaaggtagcagctatagcttaaatgttaatggggcttttgtggcccctcaaggtcaaggacctttaaacctctagaaccaagaactgtaaggacagaaagcatagattcctaggagttcaaggcagtgagctatgagtcactggaagtaatgatacacagagccattacttagctcacatattcatgtattatactgttgaggatgtactcatacacaatggtccctcatgtagagtgcatgctgtctcctggaggatgggtcccctcagtgtgttatttccaagatggtgtctctgttgtgcctttacaaggatcttcttttgctctgtaaggctggcagcttctgagtgttgtagggtgtgacagagccagtggatcccatggatatctgccacatctcctttgctgcagtgtgaattacttggttcaataagatctaacatatgacataaatgttgatgtagtaagcagtctttagtccattgtacaatggttctgacagagaccctgtgagtagaaaaggcaaatctattcttggttatatggatgatgccactcaagatgaatttctgctctttccagagtgaaaaatatttaatacaatgaacgtgccaccaagtggctggttggtcttctgaaaagatgatgtcatatgggaggtagagaacttgtctctgttggctgcatgcagtggttcacacctgtaatccaagcactttgggaggccaaggcaagaggatcacttgacatgagttcgaggccagcctgggcaacagggcaacaaagatcctgtctctataaacacccttaaagaaattggccatgcatggtggcacatgcctgtagtcctagctacttgggaggctgaggtgggaggattgcttgaacccaggagtttgaggctgcagtgagttataatcttgccacaggactttagccgctgagtgacagaatgtgaccacgtctaaattaaaaaacacacacacacacacacacatatgaaatatatataaaggaatatataagaattatatatatacacacatatatttgtatatacgtatgtgtgtatgtacatgtgtgtgtgtatgtgtgtgtgtgtgtatatatgtatcaattggtctctgttattggcagcttaggtatccaaagtggcggtaactaagatggcatatgaaatatgctgactgacatgaactggctaacttaacttggatgatcactgcctcttttaagttgctcttgggggagtattaacctgtgacacaaagatgttcacaaattatgatcattcccatagatccatccacatatctaatttccatatctcctttttctcagtcataatgtttatccttccaggcccctgaacaattagtcaattcaccacagtccatgagtctgtaaacatccttatcttgggccacttttctttccacaccaaatggaaaactgcatcacttgcagctctcaccactgggagaacttattcttacagttgttttttagggtcacttttagtttttacccacatgctgagccaactcccctgtgaaccaagctcagtcactttcctgctcggcccaccagtcatatttgtcctcatcacgcagccacaggtatgtgctgtgggagggattttgatgtaatagtgatggatgacatggagtctgggctacctgattacacatcatagttgtgccctctatttctgctcttgctcaatcccaggtgtgcaattccatcttttgatggatttcttctgcacctaccccaccttatggctggatgagactctcagaaattcatgatggaaatatctggttacaaaatcacttgatatctcgtggttggctgacacatatctcctaataactgcttttggtatatagtataattctccagtgaggtggcatgatcttggaccagaactctaggggtgtacattgtgattctcctgtcagagtttgccataaactctgcattctttcctaccactgatatatgtaataatatgttatcttttggatcatacggcccaagtagggaagccactttctcctacaccccctacgaagcatttttcctcactagttttcactgaaaacaggcagcctttgctgtcacacactaatgggtagaatgagtattctcaagtgtgaaacatgctgtctttagaatccaaagtagtgctgcactttgtcttttaatttgattggattgtttcaacatgccaaagataactggactcctaaaaacatcactgctgtggttggcccttaaatcttcatggggtttatttacactttctaggccacacatgtttttccaaggcctctaacgcacttgcaacgtcttgctactctagttcagttaatacgaggttatcaatacagtggaccaatttgcaaaatatttgggtacctgaaccaattctgcaaattagttacatggtccagatttcttctgactaattatgaataggagaaatgaggaagttaacatagagttacataaaaaagtaaacgtacagtgggaagtattagtctgctagggctgctataacaaaatattataaactgagtgacttacacaacagacatttattttctcacagttccggaggctggagagtccaagatcaagatattggttcctggtgagggcttccttcctggcttgcagacagctgccttctcactgtgtcctcacagggcagagagagtgatagagagctctggtccctctttctcttctttcactcacaggggctccaaccctcatgaccatatataaacctaattacctctcaaaggcctcacctccaaataccatcatttttagggttagagtttcaaaatatgaatttgggggaacattaacattcagttaataacatgggggaggggttttttgtttgtttgtttgtttgtttgtttgtttttgagatagggtctcactctgtcgcccagtctggagtgcagtgatgtaaacttggctcactgcaacctccacctcccaagtttaagtgattctcctgcctcagcctcccaagtagctgggactacaggtgcctgccaccacgcccggctaatttttgtatttttagtagagacgaggtttcaccatattggccaggctggtcttgaacttgggactttgtgatccacccgcctcggcctcccaaggtgccgggattagaggcgtgagccaccacgcccggccatgggggagttttggtacagatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttgggttattctccttcagacaatgattctgattctctctttttttttttttttttttttgagacggagtctcactgtgtcgcccaggctggagtgcagtggcgcaatctcggctcactgcaagctccccctcccgggttcatgccattctcctgcctcagcctccaaagtagctgggactacaggcacctgccaccacgcccggctaatttttttgtacttttagtacaggcggggtttcaccatgttagccaggatggccgcgatctcctgacctcgggatccgcctgcctcagcctcccaaagtgctgggattacaggcgtgggcaaccacgcctggcctcagacaatgattcttgaaccaagtcttctttcagattttggctccaccatctccaaaacttggtttccagagttaacttggatatcacctcaatttctaattttaggaaatgagaaaggaatatagatgattatgcatgggaagtttttaatggagaaagcctaaaactaggttgtatggttactcttaactgcaaaagagaattcaaaatcgtttttccatgaagaatcagaaaggggaatgactttattccctctacctagaatagtgcctgactgatagcaaaaattcaatgtataaccatttaatatatgaataaattagtttgctttgctctgcttcccaaccaggaatgtactggttgataattacttatccaaaatgcttaggaccagaagtgttttggatttcatattttttcagatgctttaatatttgcatatactgtacctaatgagatatctttggaatagaacccaagtctgaaatttatttctgtttcatatacaccttaacacacagcctggaggtgattttatacaatatcttatacaatatttaaaataattttgtatgtgaaacaaagtttgtattaagtatttatacatggaattttccatttgtggtgtcatgttggtgctttaaaattttcagattttggagcatgtcaaatacatatgtcttttttttttttttttttttttttgtaagagacagggtcttgctctgttgcccaggctggagtactgtggcatgaccatagctcactgcagccttgacctcctgagctcaagcaatcctcctgcctaagcctcctgagtggctggatctacagaagctgccaccacacctggctatagacctaaacatatgtcttgcaaatgtttcacatgaccatagagtgagatattacttacatccatgaaaattctgagttctagagaaacaattcaaatggtgctgtttattattgattgattcataatttcatttatatataggcagtagcaatctgtctacagcctccttagtgataatatatgtgatcttccttgttccttcacactgagtaaggtttcatccctgttttttgtaagaggtagtctgtgttttttcctttgccaataactcagtgagagaccactgccctccaatataacatcaaaagtacctgatcaactaagtcaaaaatttacttgatcttctcttatgttatgtaggaaaaaaaatctgttttggccaggcgcggtggctcatgcctataatcccagtgctctgggaggccgaggcgggtggatcacgaggtcaagagattgagaccatcctggccaacatggtgaaaccccatctgtactaaaaatacaaaaattagccgggcgtggaggcacgcacctgtagtcccagctacttgggaggctgaggcaggagaattgcttgaacccaggagccagaggttgcagtgagccaagatggtgccactggactccagcctgggcgacagaacaagactccgtctcaaaaaaaaaaaaaatctgttttataaaatcaacgtttgcttgaattgattgaatttccccatggttacaaggaaataacctagtttgccaaagatgactcacagagtttatactttaccgtttgtctttagcacatactcatatctaggtctacctctctattgattattcttccttaaaatctttttctctgagatgattatgtcatgattttacacatccacatgtatattagtctgttttgcattgctataaaggaatacctgagactggtaatttataaaggaaagaggcttatttggctcatggttctgcaagctgtccaagaagcatggtgctagcatctgcttctggtgaaggcttcaaggagcttacactcataggaaaggaaaaaggggagcagatgtgtcacatggtgagagagagagagagagagagagagagagagagaggagaagcaggactgacttttttgagcaatcagatttgatggtaactaacagaccaagaattcattcattaccatggtgacagcaccaagtcattcatgaggagtctgccccgatgacccagacatctcccacttggccctatatccaacactggggatcacatttcaacatgaaatttggaggggacaaataccaaactatatcaatatgattctgcacatgaaatgggttagcatagttagagataattaactaggctccaagtctattaagttaatataaatcctaggcaaataaattatttatattttctaacaaaatatgtattgaagctaagcaggcacatctgatgaatcattcactcttttgtttgttgtttctttttaattacacaaattttcagtgattatattgaaaatcatgcaggcaaaagacttcgaataaacaaatgaaagttcttaaaagaaatgttacatcctaatggcaacacaaaccttctaatttttattttttaatgtaacttagaggctttaagtcacaggtcagattaacttctgatgtaacccagctatgcagactgtttcctactactgaagacatgaacatacatagaatttccatcacctaaaactgttttggcatcattgtgatggcctactgtacttttgcaaattactttatcatccttgctgctttgctattcttcttgtcaatgccatgtctctgataatgtcactttgaacagtgattgtgtgaatgctcagaattactaataatttccacagacagtatcttgtagtgaggtagtaacagaatatttttccattctgtgtcagtgtcttacaggactgattttttacaagatggctttcttggcatccaatgcaaggactctcaccccaagagaaaactttatgcacgaattagaaatgagggaataaagtttcttaaactaggactgcatcagaagatgtgttctctctgtctctgtttttttgtttgtttgttttttgtttattgagacaggggtcatgcttcgtcatccaaactgaagtgcagtggtgtgaacatggctgatttgcagcctcaatttcccaggctcaagcgatcctcctacctcagctccccgagtagctgggactacagcgcatgccaccacacccagctaattttacatttttttttcttgagacaagagttttgccttgttgcccaggtctgatctagtcctgagctcaagcaatccttccaccccagcttcccaaagttctgggattacaggcctgagccactgcacccagcctgatgtgtactctcttaaaacgttcttaaaccgggccgggcgcggtggctcacgcctgtgatcccagcactttgggaggccgaggcgggtggatcatgaggtcaggagatcgagaccatcctggccaacaaggtgaaaccccatctctactaaaaatacaaaaaattagccaggcgtggtggcaggtgcctgtagtcccagctactcgggagactgaggcaggagaatgacgtgaacccgggaggcggagcttgcagtgagctgagatcgagccactgcactccagcctgggcgacagagctaggctctgtctcaaaaaaaaaaaaaaaagttcttaaaccaacaattttctataatcactaattaatgatgatcatcataacttcaaccacggtatttttaaaagagatatttaagagacttttcccctgataatttttatattacttaatttgtgtattataacatgaagggaatagggatcaccgatttgacagtctattgttcagtctaattaagtatatacaaaactgaatttccttaaaatactgaaactcaaggattaaaaataaattgtttagtaagagaaaggagaaacaagaaagccgatgggaaagacaataaagaaggaacaataaaaagtttgtgggattggttatagcttttttttttttttttttttttttttttggtgctagccataagatttatcatatgtcagataactagaaaatcaaagcctatattttaaaatccaggagccaaaatttcgacagctgttttttaaacaatgactcagattagctagctagctaggtaggtaggtagataaatagaagatagatagataggtataggtataacaaaatctttttcaatttacatcacgagtatcttatgcattaccatcttattataaatgcaaaatgtactttaaaatgctaattttgagaaagataatgactaaggcaattttatagtacttgtgatttgttccgttagtatattactattacaatttcgaaagacttatagaacatttttagtcagtctttttaagaaaacctgaatgtgcaaaatttaaaacaagacattatcttttataaaagaatatattaatataatctcatctttgtttgaagggaaaagacatcaaataacctttatttttttccaaattcatgaatttatacatatttgatcagtataagtttttgagattacttcacataaaattaatcttttcagaattattgctgttaatttgatcacccagaataccagtgatttactcacccttttcatggtactggttttcactttcaccagcttacttttctgggtgatatatggaccctccatagatatttacccctagaaaagaatctacctattcctaatatgtatgtatctcaacttacatagatgaaatatgcagggaaaggagattgtggatttgtaaatctggagtagaatttaaaaaatcactgcacagatagaccaaagtttgcaaactcagatgccagcagaggtttggtaggtaatatacaagaattgaacagccatatataaaccaatatattggggtgaatttgaaagcctacgccccacgcaaaaagagagcacattatctacaaagctcaagcaaattatttccttgctgaatgtaaaatctatctttccaacatagaagaagtcagaaatccaattctttatgtcaactcagtctcagttaaatgcaggtaagcaatttgaattactgtattaaacaatgtacaaatcatacaaaacaaatctcttggagacatttggcctaccagtaagccaatttaaaacctgtgtggggatctagtgcaggaattacagattttctataaccaaagtctgaaaaaaaaatttaaattgaattttagcttcatccaacatagccactttttctaccattacctattatttcattcctgttagctttaatcatttacctgcttgcaggtcctgaatgaccttgagattgtaactaatgttggtccaaaaatctcactgacaatgttattgcggcatgatcagtgaaagagaagttgggttcatggttgagaaacagggatgagaaatataggagactggttgaatggaggtatggtggaactatgacaatgcccctgctgtatcagatgtggcccctgctgtatcagatgtggcacctcctcatccatttgagcagccatagctatgtagaaaaatcctgaatttatgtcattaaagatgtttgatgttaacataaactgatcatttataaagtaaataatagggatttggcgtgtgtgtgtctggccttgtcagaagtaaacaaggagaatattcataatcttactcaagtcatctggggaaggattgccccttgtagtaatacttttctggaaaacaaagaggtttggggatttcttaaccctaatgctttctagaatctcagggttcagttaaaactcaacattggcggccaggcatggtggctcacgcgtgtaatcccagcagtttgggaggccgaggtgggcagatcacgacgtcaggagatcgagaccatcctggccaacatggtgaaaccccatctctactaaaatacaaaaaattagctgggcgtggtggcgggcgcctgtagtcccagctactctggaggctgaggcaggagaatcgcttgaaacaaggaggcggaggttgcagtgagctgagattgctctactgcactccagcctggcaacagagcgagactccgtctcaaaaaaaaaagaaaaaaaaattcaacgttgtcaataaatatctgatggtgacgtacaaagaaaaagctagagagaatttcagtttaaagaattgtaagttctattaaggagatattttttaacacagctcaaggaaatattatccattcctggaatacagtggctctcaattggaggtgattccttcacgctgaatccttggggacacctggcagcatatttggttgtcacaaatgaatgtggaaatgtgactggtatcaattggatagaggccggactttacactaaacatcctacaattaacagagccccccgcaagaaagaattattcaccctaaactttcaacaatgctgagcttgagagactttgctgtagggacaaaaacacaagtttgagaatttgataattctctgccatcttcaagctacatggattcccataagtaacttagcaagtatgagcctcagttttctaatatggtagttgggcaaaataaaatatatcaaagaacttgtgaggattagtgaagtaaactctgtgtaaacacctaccacagcgcctggcaaaaaagtcaggaagaaaataataattacctctcgatttcccaccctcctttacatcgacttctcacttcagtttctccagactaactttttggtgatcaaccatttcatagtgatgacgaggaaagtctaaaaattctgggtttggaagtaagaaaaaatcagagcttttgtaccaccaggatcagttttatgatcttaggcaaaccaacttagtctccgtgttttagttttcttatctgtcaaaaggacaaaaagacattttcccttgcctgtcttggagatgaaaataaatgaattactaggaaaaggagcaattttcccaggagaagtgatctataaatgacttgtgctttagcagtgtatgaaagcactttgagaagtatggacattatctaaattaaaggatttaagttattttactataagttacattatttaaatataatgtatttaaatagttttttgatgtgtgctatttattttttaagttatattttaaattagagaactatctatagcattaaaatatatatagatgagtctcagattaagactataaaatttctcacataccaatacacatttcatctctgaatagtctttcttttcatattttctcagttttgtttcttcaggtagttttctttatacagtttaaataaatattttgatttttttcccctgatttactagctttagatagtatcattttattttacttttcaaaagtttaatgacatagtgacttacccaaccatatgttctctttcctttcctggagcttgtttatattggtattttaaatttgtaaagtttacaaatttcacatttaatatgtagctaaaattgtgctctagctttactataggttgattttaaaaatataagcacaataaaaacgacatttatgatttcaaaattatgtgaatatgcaaaccaaatactgaaattgaaactgtggagaaggaaacgcaatcctatggcactaaagttctaatgctcaaaagataatgtcccaagcatacacaagtagtagcttttcctttcttatgtgcttatgttttctccacacatcttcggtgaccactaactcatgttcataatcatcctctcactttctttcttgaaggtgtttttgcttttttttttttttaaattacgttgtatagctttttaatgctcattggtttcccagtaagcagactctgaaacaaagatttgtgttcaggaaattgataggacattgattggattttgttcctaaggatcaacttggtgggggataaggggagacaaagtgagattaaacaggggagcaagattgagtaaaagaaaaagctggcctgtggaacactcataacaaaggcctcaactgatttcacagggaatctcttgggtggagatgcccctttgtcattgttccagctgccacaagggagtaggcatggggtgtaggttccacccaggaggcggtgtgatcttgggcaaggtgactctcgtcaaccaggacaatattgggatggtgggtggagaggaactcagctgcaaactttcagccaccaatactcccagcagctgggggaaggcaagcttcaggcctgaaatatgtgacagagcagggaaaaattcaggccacatgtaataggatccatccagagcaatcctcaagaggtagatttctcacgagatccttgaacatttggaaaactgggtttagttttttcattatccttcactggtaagttaatgaaaagtagaaataattttcctcaaagtgtttcttcattgtctttttagtactcagtgtctgatgggaagtcaagcggccaatcagattcctgctgtgtggtgtacatgttttactttttctctctatggaagattgaggaaagtttccctatcctgggagttctgaaacttcacaggatttggagctttttaaaattctaatcagcctttgtatgtttttaataagaagatgtgccttcccttctctgaagataatctttttctaatttatttccttgtttctttcattcactatcacagttcttttcacctggaactcttgttagataaaatccagaatattgtatattttttccattaaaataatcttttcctttattattcttccctttgtcttttcttctttttgtttcctgggacattttctcaagttttatcatccagatcatcagctagatccttaggtatattcattttcctttccgttctataaagtaacattaaaaatttttattttacattatttttcttttacttctttttatatggtttctttataaacatttattgttattttaattgacaaaatttgtatatatttatcatgtacaacaagttgctttgaaattctgtatgtatacattgttgaatggctaactcctgctaattaacatatgtgttacctctcacacttaccattttttctgataagaatatctaaaatccatcctctcagcagttttcaaaaatataatacattgttattaatacatactgcatgatctcacttatatgtgaaatcaagaaaaaagttgaattcatgaaagtaaagagtaaaatggtggttaccagaggctgaggtagcggggaggtgttggccaaaggatacaaaatttcagttaggggaaatatgttcaagagatctactgtacaatttggcgactatagttaataattctcttttattttggcagcattctcttcttttatgaatacaagtgcttgcttttctcttaagtctgtgctgtagataatttctacctctgctttagtcagccatatgcttccccattctggtattttcgttcacatttggttcatatgtttggtggtctatgagtcattatttcatgaataaaaacacaactagtttaattgatataagttgtttgcataggtttactctgcagatacataggtctggttcccaaagtgactaagttacgtgtgtgtgtgtggtatatttgtgtgtgttgtgtcagtctggactaaattttatataatcataacatgtaatattatatatcaacatatataaaatatataacacatacaatatatgctgtattttggtgtttgttttgtatgttttacttgttatatataccatatattatgtttcatatgttgtatatatgctatatatatatatacataatgtgggtatatttaaatgtgtctatatgtgctttttaaagtctaaatgttccaaatggttcttttgcccccaaatgtgtcttctgttagccttaaattctcattattttaaatattttcatgaagtatatcttagacacgttttttgctcttttttgcccataagaatcctcctccccagtcccaccccttggcccaaggaaaacacttctaatctgattagtgtgaagtcaaacaatagtgaattcgtactcactagcgtgcagattgagtatgcattaaatcatacatgtccattttctctgtctccttggtacttacataaaggtggaagaggactaggtttccagtattcgccatattatgcttcatctcctctccacttccttcatctatgtgaaaagtccaagaataataaacccttgagatacatattttggggcaacatataacgttctacataggctgctcaaaactggagtttacaagagcggtgtattaagatatcaagaacttgtgcaacccttaatattatgttttggttcttatttagctgttattctttttgtgtattgccctattgaaaactgttataattgatcatacacattgagtcattcttgtcatatccaaactgaaacagagtctagaagctgggggaaaagcactcagcttataaaacattcctccaagaatgtaattctctgcaagtctgactactaaaattgcttgttgtaacccgaaaccagttttatctacagcttctgagatgacttgctgcaatgctaggactaattctgcccaccaccattgctcaccaatacgaacttgccagctccccaaacacttactagtgtcagcgaactttctcaaagaacagtatataacatatctccttttttataaaacctctagccttctctttgttctttggacctccagaatacccccagtccatgtgtatgcctcaaactgcaattgtttcttcacaaacaaaacattaaatttggagatttatctttacatatttattctgactttgaaaagacatagaaaaagagaaagtatatgagcatgcatttgatttaataaaagtctcactcctaattcctaattcctagtcatgcccattcaagcattctactatgtctgcatgaatccatttaaaacagtaaatattaatgaagaaaaaattctcatttatcaattagcacccaccaatatttattctcaaggagttatattcacgatctagattctctacatgtgccaccaaacaccccacttttaccgctcctcattctgctcaggctcctgcattcaagttctaactccacttacctttgtctctctaggagaaagtaaacacacattctaacgcaagtgagtattttttggtactgataacattgaaaaatgtccaattcaaaatataaaatttctttcacatcattttatgtcacactagtaagaaatactagaattagtaacaaattacttttcgcctgcctctattctgattgtaacttaccaatgtgtttctacttcgagattgagaagtatagcattaacacgttggaattaattccctggtttaactagaaaactgccaacaagggaagtgggacataaatagtttgataagaataaagaaaatccaaagcgttacactgcctgcaaaatgaacaggtacctgtacctgttcacaaagtgaacaggtgagcagtcatagggcactatgctggttcattgcctaagacggcacaggtaggcttgtctatgtgtatgaccgatatgtgtgtgcacatatccgatatgtgtgtgcacatcggagacctacggggaggtttgcaggaggtgttatagaaaacggttgtttcttcatcattttgccaagagctcttgtcctccaacctaactgtgtccatacacagtggagcattatttgagtaaatgactgagctctgggaaatgggtaaatgaccccaaggcagaaaggtgtaaataggcttgcctgggcttctgtgtgtgttactctgctgctgtgacaaccattgctagcataacaataagatccagggttacctttatggttgtgttgagttgttggggaaaaattagaagagaatttggatcatctattctcaggagacccgtttgaatcatcaaagcttaatgtcacttgtctctatctctttcaaccatgcattccacacaccaatttgcttaaatagtggatgcacatgccaaatctaattatcccttatctcacaaagtcattaatcattcccatccattattcattgactaccaatagctactccaatctttagtacatgcaacttcagtgcacattacaataccctgtttataagtggcatttatctctgaaacgtaccgcatggcatttttaagttagatgaaatattcctggcataaaaactggtggtgtgttttatggtgttcttctcgtaatccataaaattagtaatataaaaagaaaatgctcaagataattgtgaagctgcagataattattcatggtgatgttaattagcacagtgttgtgaaaatggtgcacaacctacacagtattcagggatcgcaaagtactttgaaaagaggttgtatattatccaaaaaaagcagaaggaaagtggtgtgagggatagattagcctagttaaaagacaaaaacaatgtgaaatttggggtaactgaagcattctctagccatttaatattctcaactgctgcatactacacaattcatattgtcccacatatactttaaccttttgatttcctctaaaatatttgaggggtacttaaatagacacaatgattaagttcaaatctcattttttttcccaaagacacttacacagtctatgggacagcagagatttgaacacagatctcttgatggcaacccagagctatttcgttaatggatttattggatgaaaccaagtttttttcagtgccttctacataacaagttactatacacagtgccattacatagcattttcagaagtctattgaaaacgctaattatttatctatctttatatctatattttcatctataacctctatttatcatctatcatctttatttatagatgagaaaattgagagtcatcaaggttatgtatttttcccaagcttcctagttaataaataggtctgccatgatcctaatcttaatttatcagattcaaactgtgatgtgcatatttccaagactaccttttgttagtttcctgtcttgctggcaagtaggaaggacttattctttctttataataaaaatgttaagtttcaaagattccatagagaaaaccttgtccaagccacttattttaaagataagaaaactgagactcagaaaaggtacttctttacacatatataattgttgtaaactttaggtaaagcacgcatttcctaactattgatcttattggtatattttctataacattatgctttcctcttgagaggctcacaattggaatgtcatacaatcttttcctcttgtattttctctctttctagttaaaatcaatacataatgtaacattgagctcaaaaccttcatcttccataaatttttatcagatttcttgtgcacaaagaatttatcttttcttggaactaatagaacatatatatgattcaattaatcttttccatttgctgtatctttttatttattctgcctcataatcactcatagtttcttaaacatgttcatatcttatcccatgagctagatgacaaagttctgtgagaaaaactcgtacacttcctgtttctacactcttcctgttgtattgccttgccatggtaagcactcaattagtatctggtgattgcttgcttaatgtttgaccaggacaaagagtagattatttagcctattttatttacaaggtacagcaagttaaatgatatgtggttttatcattaaaaagtgaaaagggaattaaggagattgaaaattcactgcaatgttctgcctgctaccatgatggtggaaagccaaaacagcaattttaccagccagcttttcctgtggtgtgtttctacaccaatgagctcagtattttaacataaactgtataaaaataactgctagtatttatacttcaaaatgtatctatttagttgagtgtgatggtgttcacctataaccccagccactcgagaggatgagttggtaggagcacttgagtccaggatttcaaggctgcaatgagctcagacagcaccactgcactcccgcctgggtgacagtgtgagagcctgtctctaaaaagaaaaatcaaagtgtctgtatttctcatatttcatcacacttttggagtactgacttgtacatagatttctgaaaacgctttgtaagctgaacataagacaaaaagaagatgatgagaaccagccttatcttcttgaaaataattacgaagctataaaaagaaacagatacaactagacaaggaaccttaagggtcggggaggggaggaaatacttggatgccctctcttccttctggtcctcttctatgtgtattgattgcctcagacaccttcagagtaatcatattgtggagagcatggatgaacatctaagagggagaaaatatcaggatattaagtaaaactaggttttcaaatgcaataaccactcactgtagcttttcggggatgatatttgcctggcaataacttttgatttaagaaaaatctttttcaccaaaacctatcccttctctgagatgggttccaatctagataaatggcaaagctattctcctgtttactcaagacccaaacctagatgttactgttgatccctttctctcccttacctactatagccaatcaatcaccaatttctgctgagtctactcccaaatatttcttgagtctttccatttctttccaatctgttactatcactgtagtctgaaccaatattatcttttacctagaccatttatttactccaaagtaatttctatcactatcgaccaccaaataagtgtggaagttaacagtgccagctttcaagtcagactgctcactggttagctaagcaatattaggcaatttttaaagctttttgtaagatgaagataataatatttaccttgttaccagcagcaaatgggtctgcagcactcaatacttgcctaactggaggaaaaaatttggctgagggccagaagtaggttgaaggcaaagggagagataaaggcaagtttgtttttttgttttgttttttgtttcttgttttggagacggggtctcactctgtcactcaggctggagtgcagtagtgcaatctctcagctcactacaatctctgtctcctgggttcaagcaattctcctgcctcagtctcccaagtagctggggctacaagcacatgccaccacacacagctaattgtgtgtgtgtgtgtgtgtgtgtgtgtgtgtgtgtgtgtgtgtgtttagtagagatggggtttcaccatgttggccaggctggtcacaaactcctgaccttaagtgatccacccacctcggcctctcaaaatgctggagttacaggtgtgagccaccgcgtccagcctaaagcaagtttaagagcaggagtgaaagtttattaaaaagttttacagcaggaatgaaagcaagtcaagtacactaggaagagggtcaagcaggcaacttgagaaatccaagttccccatctggcccttgacttgaggtttcatacattggcattcatctagggtttgcatttcttctcccttgattcttcccttggagcaggctgtccacatgcacaggggcctggtagtacttaggaggggctgcatggtcagtgtgtttactgaagttgtgcaggtgctcatttgaagcatttttcccttaccagtagagtgttccagagaaaggtcatataccagttaaactgcatcattttgtcttttactgtgcatgcctgaacccacttgctcaagtcctgagatcttatcaggaagctgctaatcaccagcttcaggtgttttctgtctattgggagactggtgttggctgtggccaattattgttttagcaagacagattaacaaccacttgatcatcacctgatggtcacctgacattccagatggggggccctctcctgtcctgctcgagtatgcctacctaggtactctagcatttctgccctcaagagtacaagactcaattatttggtataatggatgaaagtcagtcttttgtggtagtatgttctgtgagtcttggtctcttgctagctgtcagggaaaagtggctccatgggttggtgaaagtggtatccagctaggtccaagggagaagggcaggaattccactctgttgtgtttctctgatgggcattctagggtcttctaaaaggatgcctcttgaatattgagaggacagtatccctcattgaggattatttggaatttgatggcctgaaggcaagaggagacaaattgggttattgtgcttagaagacatgtacctgtaccaaaaagactaacaagtgggcctaaaaagggaaaatcccaggagaaccatttccaggtttcttcccaatttagccagttctgagtgtcttgttctcataaactggaagttcaatttaaaagttgtctgatgtggtcttgtacttttcccaattgatttaccccaaagcaacatttttcatctgagtctaaacagatttctccctgtgctgccagtaacatatctaggtcttgacaattttggaggactatggctgctaaagagtcaatttgttgttgcatagttgttaaagttttatccatgtcatcagtgttgctgggtatttcctttgagagttggctacaggccaaggaggcttttgtgattccagcaattccagtacccataccagctataatgccaagtcctatgagaaggggggttaattggatagacctcctcatcctgggaaggatggaatgcctctggattggtgctggaagagagagactcctggggatttgaagatgtcagggatacataggctatggtacaagttccagactagttagtcagaagacattggggaactgattggacacaaatatagaaggttccttggacttaaagacaaggagccttctatatttgtggagagggtagagatgtcaaaacacaataaagtctgaccctttctagcatagctagggggcatgcctaactctgtatgttcccatgccttgcctagaatttaatggatttaaagcaggcaagcagtacagttactaagagtcacagtagcagtttatactactaaagcatttagtagacctaataacctttacaattttacatttttttaaataaattccctttcacaatttgtttatgacttacataggtcacctacaacatacttggatgatttgacttgtcctaaacatccctctttgtaaacaactagtcattttactttaggacaagaatgtaccatgcaagatcacttctcatataaaatctattttctttataacctttcttaccaaaaaatctctttacctttataacctttgaattagactaaagtaattttccttctgttaagaagttatgttgctgtgcaagtactacgaagagggagaagataaggagattatctgaatactttagaagttattctccctcaagggattgctcagttagatttcttactagggcttctctgagtaaacatggactatttctaaacccttgaggtaggactatccaggttgaagttaaagatttaggtaactttcccaggagaaatagggctactagagggaaagattaattcagagtttgggtagatattaagcaggcacccatcccaaaggggtgtggggcttttagacattacctggtacttatgtaagaatagtaattggcccctaagtaatataaaggtgtgtgaatcttttcttttcgagggaagtgataccattttcccccattacccaacaggatttggaggagagttgcttagagaaggagattagcacagactaggcagctctcgaacccaaaagagaaatttataactacttcctgcctccagagttgcccttggctttgtcctgttgatggccagcaatgtctgatctgggagctagctggagctggaaccccttcagtttaaggcctttattggattggagcctggcccaggggcatttttggctcttggaacatcctttttccagtggctgagcttgtggcagagggggcaggctatgtgggggtttctcccatttggcccatttgggcaattctttttccagtggtctggtcttctgcaccaatggtagttatctagaggagtgtccttacagcaacctggagggggctggtgggcttgcagagcagccagtagttaagactccctcctgtttgtgcatttctccttctccttagccctgtcctccttattctgctctaggttttgaaagactgaggaggctaatttgagtatttcttgtataggggcactgggtcctgaggctgacttttgtaattttctaccagatcatttttaggctgaacagtattacaaaggaaaactagatttttgctttaagatttggggggatcaaaattttcccaggtttgggtatgcatcgaagggtcatgtcctgtggtgtgcagacgcaattaactatatgtgcagaaagaacaaaggagagaagaaaatgaagacatcctttctagttttcctaacatctttttcctgcacttatggcagactggagtgaacagagtgttccccattcatcctaggggttccagaatgaaccagtgcttactgggtacccataaccttggtcccatcttgttttatgaaggtacaattaaccatttgtgaagatacaacacatgagagaagagaagaggagggcaccctcccacccctgtttttccctgaatcctttgcctgtggcagatcagagtgaacagggtttcccccattcatccaaggggctctggaatgaactagtgcttgctgggtacccctaaccttggtcccatccaatttctgggaccagccttcatctctgtcctacaggtactttggtctcttatgcctgtggccttgggccagcctatatctttgttgccaagaccttacagtgactcttgttcagagcattctagaagttacaagagctggcagagccagaggtccaattagtgtgtgtcctggcaatgagccgagacacatctatgagaaagcccatttctttgttgccacacaatgcagcaaaagctgtggacatataaataacaaactgggaatgtggtcctgaaggagcacaagaccatttcagaatacagacagacaaaacaggagaataggcagtgcaggttttcaggaaacaagcagaggaaaccttgaacattacacggccttaggctttagccctaccactctcaggagcctcctgtccaagagggccattagtgcctcaggtctactctgtgcagactccaaggtccttcccaaccccatgagtcactcatcagggggagctgtgagatcagctgagaacaaagccactgtgaccaagaggaatcattctgggcattggttagtaagcaggagagtgaaaggggagaaagaatccatgtacaggggttgtacgccctcagccaaagaaagcaaggcatagaggtgtcttaccactagggaatgtgcctgagtcacagcaccaatgtatattaccagcagcaaatccatatggatctgcagcaaatcaatccttgcctccttggaggaaagaatttagccaaggggcagaagtaggttgaaggcagagggagagaccaagacaagttgtagcgggaccaaaagtttattaaaaagttttatagcaggaatgaaaggaagtcaagtacacttggaagagggccaagtaggtgacttgagagatcctagttccctgtctgtcccttgatttgaggtttcaaatactggcatggttctgggatttgtgtttcttctccatttattcttcccttggggtggcctgttcacatgctcagtggcctgctagcacttgggaggggtcacatttgcagtgcagttactgaagtagtgcaaatgctcatttgaggcatttttcccttatcaatcaactgttcctaaaggaagatcatttactggttaaactccaccgtttttcctcttggtgcacatatttgagcccggtcatccaaatcctgagagcttatcaggaagcggctgatgacagattcagctcttttctatctgctaggagaccgtcttttcctggtgtcagctgagaccaattattattttagagagacagtttaacaatcacctgaccatcacctgatggttgcctaacattcctggggcagccctctcctgctgtgctcatgtctccctaactatctactccaacaacctcactgggttgttttaaatattaatgtgttaatagacgtttgccccaaaagaagcctgctgaacaggaagatagtcagcaaatattagccattattttattaccgcacccaacaggcccagttatatcagttatatataaaatgcctgtctgattatgccttttttttttttttagacaaagtctcactctgtcactcaggctggagtgcagtagcctaatcatggctcattgaatcctcaacctcccaggctcaatcttccaactgcagcctcctgagtagctgggactacaagcataccaccacacctggctaattttcttattcttatgtaaaagtggggctcttgccatcttgcccaggctgctcacaaactcctagactcaagcgatcctcctgcctccatctcccaaagtgctggattgcaggcataagccatcatgctcagcctgactatgcccttttcaagcttaagaccattcaatgacttcctattatttttggaataaattccaaaattattgacatagctccacgtgagcattcttgattcacctctgcacacctctccagccatatctttgctattcactgtctccctcattatctgatcttgagcagcagtggcttaatttacatttcttaggcacacaaggttcatttggcctaataaagcccctgcatggcagctctcttataccttccttggactagaatcccagttatcttcccttcactcctgatgtttcttcagaaaccaacttgaagaatactttctcagggccatttactatgtgacattattatgtgaccactcaagacaagatcaaatcccatgtttatgcaatttcctaatacctagaattatagccaattagttacttatgtaattatatgtctttgtttctatcatgtaaattttattacattaagtttgtaatgaaatgggaaatgtctgtttgttaaccaaggtatcactagtgtctaaaagagtacctgacatctagttaacgtttaacaaatagttacagttatagaataaacccattataaataaatgaactaaaaaaataactgtggagttactctgattctgttctttgactttctagggattaatgctggatctacttagcaagaggacagccagggacaccttagagataattcatcctaaccactccttttacaaataaaaccagactccatgcagctataaaaagagcctttctcaaccttcctccagtcataagttcttttgtttctctatctaccataactgtgaaaggaattccatactttaactcgggcattagtggtgattagttgtccaattcataaagttgtgcattgctgaaaggggtaatccaaaggtctagaattcaaatgtcagaagtaatgagatcagtaaaatacaaggataaaaaaggcttgagaccacaaaaaagtatttcttctatctcatcttgtaaaaatcatctctgagtataaaatataacatgatgtatatttttaaagatttctcaaatgaactctaaacaggaaaagacaaaattaaggatagaaacttggatcttggttggtgctgtaaaacttgagaaagttatttatttttgttcttttccctatgagggaaaatggtatttccaatttcaagaaatccaaacatatataagctttgaaatcagaaaaattagaagccaattataccatttttaaagtattttctttgcttcctcaaatagtgagccacctaagttcaatagatcataatggcttttttttttttttttttttgagacagagtcctcgctctgtcgcccaggctggagtgcagtggcatgatcttggcttacggcaagcgcctcctcccgggttcacgccattctcctgcctcagcctcctgagtagctgggactacaggtgccctccaccacacagggctaattttcttttttttttctgtatttctaatagagaccgggtttcaccacgttagccaggatagtcttgatctcttgacctcttgattcgccctccttggcctcccaaagtgctgggattaaaggtgcaaggcaccgcgcccagcccataatacctttttaaacatgtatttaaattagatttttaccaagccatattaccaggctaagtaaaaaggtacctgtttcataattgagatcgtgtatatatttccaaaatgaccaaatacatacttttattgaaagcaacccatattttgaatacctttatcttatataattttgttctagtctacaccatcattgctactgacaaaaattatatagtactttattgtactcaagtttgttttgtcttgttttgagacagggcctcactctgttgaccaggctggaatgcaaaggtgtgatcttggctcactgcaacctctgcctccagggcttaagctatcctcttgcctcagccttccaagtagctgggactactggctaattttttgtatttttttgtatagacaggatttcaccacatcgcccagcctggtcttgaacccctaggctcaagcaatccacccgcctcagcctcccaaagggccaatattacaagcgtgagccactgcacctggccacatttcaagatattttgtattttctattcttgaacagtcttgactgaacatgaatgctctctttctgtccacccggagtagttgaaagatatttatttaaaagtgatattaatgatataaatagataaaagaagagtatcacctggataagaatttggaaataagagaaaagtttacatttgaaatgcaggttttacatgaaatatatatataatcggagttgttttttacagtgaagttcaactgttctttttgttcttgctgttccgatgctctctctcttgtttctttttgagtgtcacagacatttatattcctcttttctcaacctaacctttccctgattacaggcatttgtactaattactgtgattccacagttcaacacagacagctttgttcccactgctacagaagcacagagctgcatcaatattgagtagggggttcttgaaaataacctaagtggcattttggaatagatattcctccaatgggtaagatacctacctaaaaccacaaaatatacattcaatagcatatttttttgaaattctatagactttccaaacaacttggtttagaataaaagattcataatatgctaacacaaatgtaaatattgtaccaggtcacacctaaaggatggaaaagtctagtaagtgaaaatgcccattactcttgggctgtaagattttctaccagagaggttgcacagtaatataccctaactgttaagaatgagaaagtttgttgctgttgtattttgttttattttgtgggcatctgtaagaactagagaaaaactgtagagtcctgtgtgtgttttgtttcacctatggaatactgattctcttcgtgttaaaatgattaattcttatttgttataaaatagagaatattatataagttctggattcctgtattctcttgaaaatcatgaagttctgccaactctgggcccaatttcatctagcagctactgctgcagtatggtgcttagactcacagagggaggtggctttccagttcagccccaaccccacctctgtctttgcctaccatacactgaaacctagagtcagatggcatttatcattttttccctaatattagagttgaaaatatattttgtaaatatctgtgtttctatcaagatgggtaagattaaaaatggacccgaatagctgtatgattcaaataaaagaggtgtagtccaaaaagaaagaatatttctttgtggaaacaagggacattccacatatttaatttgtaatgttgtctgtgtgaaagactacatctttgtcatctgtgcattctactttactatacacatttatatttatttacttgccccttagtagcttagtctacagccactgtgactgtcatattcagccatggtgtaagctgacatttttttaaatgggtgtgtgaacatgtgtacacttcggaaaaagtggcaaaggatatactccctatgtcaactcattatacctagttcatgcgtttatcagttattttaactttcttttgtttatctttttcatgttatgagttttgaccatgtgcttgtgttagatttaaaaacagaaaaacaataaaataaaatgaaaaaagtaagaaaatggtttgttcagaatgctaaacacatattccctttttgttcccctctggatgcaattaatgcatacttcaatcttcatagaacctaatccaaaatgcaagggtctttataatcagccttcccaaattgatttttactcaatcaaaaccctcctctccagacatattgatttttttcattgtcccttaaacacacctgaactcggaaccatttcctccttcacgtctgtatttattctgttaagcctcttgacttccctcccagcccagaatatcttattttgttgatgcatcaaaatactcacatcattcaagtccagttcaaactccttattaatgcttcccttagacgccggaagtgatcgctgttctccctaattgcaattgcacttaaaccaactgtagcgaacagctcaatctttgttaaatatttcctcataattcctctgaggagcactaagaccctgagatattgatagtttttgtgatataaaaatttccatggcttaaaaaataatgcaaaaatgttcagaaacatttggtttaaacaaaattaaccagatttatttactgcagtatttctcagaccattagaacatgtgtagtctcctgctaatagtgaagagtggttttaatataaggaattttacaaaattttgtcagcatcaaactgacaattgtccttatgattttgtccatattttctagtagaataatgtcctgcagaagataatttgggtgatcccagttcataatatagttttatgtgtatctctttatttcaaaccagctagcaaatttctagtcactgaacttgttcttacaaatatttttacacgtcgagatccttcaacacttatgagttcatggtatgtgtgcaaaaaccacgaatagataaggaggggagtaacaatacattgtccattggctaagataccggagcagttcaaggggacagtcatcccagattcagggaaacaggaggaaacccatcaaaggatattaggtaacctctgacagtctggcaatgtttccctcttcatgacactcggtccttgcttctcctcttctgtctggaccaaatgatttcaaactcaggcttcctgtagctctccagtgtgaaagaggcttaaagagataggatcacttcaattcagggtgcagcctcatttttccctctgctgttcacatattgataggaactttacatctgtcatgtctccttttatagatgaatgtagggagggtggatgataatgcattccaatatttattcaatttcaaaatgaaagacaagttgaaaatccttcatgaggatgcaatccacggaaatatgagagctgtctacctaccatctctaacagattttggcctttgtttatttccgaagcacttatttgtcattaagataatttttgtttatgttttctcaggcatattatgattcccttaagtttccagagagccttgttctatgctctgtaaaggagaggcatatgtgggttaaataagaatttaatatatgcttaatgaatatatcacttatttgtagaatgcattcttgttcctccttgatattcttgccatgccaaaccatcacgatttctgtcatttgccaaagtatattcttactttgcacttacactgattacacctgatagcccattttgctgagtcatcctactgttctctgtgtccttacttctcatagtgttgtcaggaaaccagcagcataggcatcccctgagagtttgatagaatgcaaaattgcagctccaactccagacatagtgattcagaatacgcatttaaacaaaagtccttggcaattcttatgctcattagagttggagaagctctgttctaagtgttccctggatttttcactgtgggctgaggcacgtggtatatagacatctctctctctcttaacttcttctgttctcctgggcattgtcttcaatatttctctttctttttcctttcagcaagtgcacctgcttaggactcactaaaccattttcacaattaattttccatctaatcaaaaccctcctatccatatatctctactatcactccaaaaataaaagtttcattgaggtctgcctcccctatagttagctagctcagatggaagttgtaggctattccacttgccaggcatttttcagcccattgtttgcatttttgttccatcattttcctgaaactttttaagtcacaattacctaaaattgttgaacatattgagcattttttgaatttcagttgtctggtctctctgtcacctttgacactgttgttacgttcttccttaaaactctctttttcctcagcttctgagaaataatcctcttccgattccacagagactcagatggttctttctcatttccccacatctgtgttcccatccaatcggtattatccttccatccatgcatccatccatgcatccatccatccatctatccatccatccatccatccatccatccatccatccatccattcatcttcagctttctttttttaatctctctatacattttttataaatgatgcttctgactttcaagacttcaactaccagatccagagctactgattcctttcatcagtgaccatgccttttctcccacatgcctctctgaatgtgagatatctctccctgtcaatacaacccacactaaacttattttctccccacctcttccattctatattccttagctgggctggtagaattgaaaagtctttctcaactcctacttccttttctgtgcacatccaattatcccctgcattctgtcaattccactgtcttaacaactcttaagtctatcttgccttcctatcacatagttaccaacttaattcagaatttcttcattatttcttaccttcactgcaataatggtctcctagtaggttttctttctccttacccacagagttcttcctaatcaatttttcttacttcttacaccatgaaaaagcttcccttctcattctgtagccatctcaatgggtttgttcttgcaggtctaccaaaagcaaggaagggctcctgaggttataccaatgtaaaaggatagaaaggtgagtaattcagatgagatgtggtttctcagacaacactcccttccaacatctatgaaaatagatgaacatgaagcaaaattaaaataatagcaaatagtctgggcacaatggctcatgcctgtaatccccgaactttgggaggccaaggcaggagcattacttgattccaggagttcaagacaagcctgggcaaaatggcgagaccctgtctctacaaaattaaaaaattagccaggcatattgatatgtgtctgtggtcccagctacttgggaggctgaggtaggaggattgcttgagtccgggaggtcaaggctgcagtgagccctgattgagccactgtgcacctgcctgggccataaagcaaaaccctgtctcaaaaagtaacaagaagaagaagggtagcaaataaatagcaaaaatatagcaaaaaaagaaaatatagcagtccataaaaataaaagttcaaattgattctgaataaaaaacatgctttcaaatccatctgaagaattcctaccttagctactgatttgttatcagaaaaaacaaacactgtgaaatatttaaagaggtttattccaagctaatatgagtgaccatggcctggggaacagtctcaagagatcctgaggcctacaggtatcctgaggtggattcaaagattttctgggctgggcatggtggcttacatttgtaataccagcactttgagaagccaaggtgggcagatcacctgaggtcaggagttcgaggtcagccgggccaacatggtgaaaccctgtctctactaaaaaaaaaaaaaatacaaaaattagccgatcatggtggcacaatcccagctactctggaggctggggcaggataattgcttaaatccaggaggtggaggttacagtgagccaagattgtgccactgcactccagtctgggcgacagagtggcgccatctcaaaataataataataataataatttctgatttggaatttgttgtaagagttaagctttatctttagactggaagtctttgtctaaagacttgaagttagtaggcagaaatgctcaagttaagattgggggtgttgtgatgaccaaggtttctgttatgtagatgaagcctcaggagttgcagtccttacagagaatagatggtaaatgtgtcttttgggaacttgaaagttttcagactcttacttaatcttttctagatctgaaaaaggtctggaaagggaaggcctggccgcattaatggagattctctactgatgcaaatttcccccacaaaagacagctttgctgtcatttcaaaatatgtcaaagaaatatattttatggtaaaatattttatttccttcgggatgtgctttctgtcatttctgtcatgtgatgttatactagaatcaggttggaatttagcattttattgccacaaggattcttttttgtcagtcttaggatctctgttttaactttaatgcctgtcacttatgcctaagctccaaaagggaggggatataatgaggtgtgtccaacctcccttccagttacggctggaaattcaggttttcaggtctttctagggtccccttggccagaagtttgtcagttcagccagttggcggaactgaaaattttacttacggtttacagactttagaaataaaccccactaattgcccatcctattttgagatggttcattcatatatgaaaaactcctgttcctttacatcttgatttatacctaaaaactctgtgcaggtatgatttctgtcattccagaattctccatgcctacaagtagtgttagaaatttcctttttgcaaaactacttcttctgaaggagagtgttggaagctatcttatagtttggattcatgggctggggtttggaaaagagaattattccagggggttatgaagaatcctaaaatcttaacagagcaaaatctcccaatctatatatatgtatatgtatgtgtgtgtgtgtgtgtgtgtgtgtgtgtgtatatatatatatatatatatatatatatatagtttttttttttttttcttgagacagagtcccattctgtcacccaggctggagtgcagtggtgaaatctcggatttgccattgcattacagcctgggtgacaagagcaaaactccgtctaaaacaaaaagcaaaaaacaacaacaacaataacaaaaacaaattggccaggaacatttctgtttaggaaatttaagaccaaggaactgaactaacattgggtacttaccagagtctaagacctgttattcatgggcatttagataagttttctcatttaatgtttataacaactctattgataaggacatgttctcaatagagaaaaatgaggaaagataaatgaaaataacaatggagtacttaatgccaaaaactttatcaggcgtcgtgaggtatctattatataaagctcattttgcagatgaggaatgctgctctgagaagatgagtgagctgctcatggaaacgcagctcttaactgctaaagggaggaagtaaagctttgcctgctttacttcaaggcccgagctgttttcattataacaatctacagtctttaagataggtgaagaccattttggacgcaaatgagctaaactgcttatctatttgtgttttaatcaggtctgtctgtgaagttatcttccagctattttgtattcaccccacgatacctagcactgtgttctaccatacatgaccatcaataaatgtttgctaaattgatggatgggccttgctgtgctattaaggaacactcatcacgctacaggaattgctttgtccccacgttaacagacaactggttatgatgaacttctaaaggaaaataaaattatgcttctctgaaaacacatctaataaaatgaggatgttattatcatttggtttgtttttgagaatatcgatcttaaatacagttaaataaatagctggaagattggaaataacattaggaaaaagatcttttatgagacatgataaagaacaataattctttcatatatacatttaagtacaaattcacagaactccttctgaagaaacaattgattcactcctaagtttaagtacctattaaatatttcctagtaggaggtttcatctatatgttacatgtcagtagcattacgtcaaataagagtaactatttggacccattctttggggttgaggaatggaggtgatagttattatgcatgaagtggctgactggatggtgcacgtcgtagactgcctaatgttgatattcaaaacaatcatatgaaatatgtgttactataatcacatttagatgggaaaactgagtgaggaggaagtcaggtatgtttcctggcttacatgtctagtacatgataaagccagaatttaaatctgtatgtctgattccaaaatctttgtccactctgcttctcccatgctacctccaatagctcaaagtatgaagaaggtacagtgacgcaaatagggccttcatctaaaaagatcagagtaatagcataatggataataaaatatttacaatatcaacagggtcaggggtaagtgcatttgtagaaaaaaaaatgactggaaggaaacaccacaatgaaaacagtggtttcgttgtattatattacgttttgctattttagtaatggaaaattttaagctcatgaaaaagcaagataagtgtattttaggacaaggctttacatcagattaaagaagatttctgggagagaatcagcaagaggccatcgtgcagcctggacagagggagggaacgttccacactgctgctctaacagaacacaagcaatggcatatggcactaatttgtgaaattacactttaatttcaaacccaggttaggaagagtagtcatggctggagaacactgaagaaggcttccacctattagctcaaacagtcaggcaggtactaaactgatccagcaggcagcatgctagatgttggagatagagagttgaacaccgtcatgtacgtaaaaacagcatattgtaggagcatactttagggttgtacttctttatagatcctctgaagtggggcccttgagatatatatatatatatatatgagcaaatagaacataatagcttttctacttccttctgcattgctttttaaccttccttccttcctaatatgtgcatcctgcctcaattccctatctaccttcttgcatactggcccaatatagagaatatattaattattactttccttataatagcacctcacccatctgttttatccagaaacccagttttacattccattttcaaggtcagcgaaaaacagagaaggcctcagcattatgagtgctgccccatgagatagtaggtagaatggcccatctgttaaaacactgttcataattttaaatggaacattttaaagctcagtgaaatcatttctactctccagtacaatgaacttctattctcttacctcctggagaggttgaactgaacatggaaaatcgggcctttttggttcttgtagtgaatataaatggtgatatcaaatcaccaacttggcccaggagataatttcttgtgagtcgctgaggctggctgttcaatcttacatgttttacacataattccagaccattttgcagaaggtttcttggcttccatcttaaggatcaaaagcaagtttcctcatggtttgtgattctcatgccaaaagggtaaatgtgcaggaaggtcataagcagtagcaaagcttctctcacatctgccttgagcttgagcagtcaggcttgctaatttgacctcctattgtcatttagaatcttctgccaggagagtttttttcttttttaaagaagtgagaggcagataatttgtttaaattatttatatttaagaagtggaaggaacagggaagaaaaaagagatgtcttgattttctgaggagtatgccatggatagacacttagggcacaaaacagcagctacctggtttatgctgaaaaaaaaaacaaacatgtaaatagcaattattgtgcagcagtagccctgaggaggattctctgcatactcaatctttctaagcacccctaagtgtcttggactctccattacagaaaatgtgtttaggtctatgaatggaagagcgcacctgtgtgtgtcctgtcccagtgtttctgtgatgatgtggatgtcctatgaaaatattagtaacagatggcaatgtttctctagccttgatgttattctcatagtatttacaggtcgcatcaactggtcagatgtggctacaaagtaaagtcataatacttcaaaaattattcttcttgaaagctcatgtatatgtattctcaaaagacacactcaggcagttagaaccagtgtatttctatgtaatgacctgttctcccaaacatggttgtctcattgcccagggattaaaaggggaaatgcttctaacaatcagcaaaggcaaaaactgcaaagggatggaataaaaaaaaaaccataaagcagacataatgatttacagaggcaagcaatctgaggttatctatttgaggagccaataattacatgtatacaaataatctttggaggaatagtacaaaaatggatgtttcagaggttgacccaagtcataatatttaaaatccctagtgtaaggaggcacagagcaatataattttagaaaatcacccatccaaaatatattttaaaggattttcacctaaagatgacattccttttaccaatgatgtagactacattagttctccttccctttaggtctgaagttcagttagctcagtctcttttgtactaggtagagtttgtggctattcccttgaatagtccagatgactttgctcttaacaaggcagtcccagagtagttaacatgaaagccacgtgtgagggtgtgtgtgggagggagagaggagttggtgggaagaggaggtcatctgtgctaatggaaaataaactcaaagggcatatccagcatcacctttgtatgggaagagcatctatttggggttttcattttctgataggcagtgatagaattacaactaatataataaataaatagaactttagagagtgcaagaaaagaatcccagccctggccagtgatttgatttgctctagcacatccatctgactgagccatctggcagtgaaccagtggtatcagaacagcaatgggtgtaaccttgaggaagggttgccccttgacaaacagactggtgggaaaagtgcaggatgtggcaagactgaggatgaacaactatccaccctgcagaggatagcgacatagggagagaaatgcgtggtgcacatcactttgtcctgagtgtttggccaggccaggtatgaaaggcacttaggctggatacctaggaatgtctaacagcaggtggagcaggcaagaaaggaggccaggctctagttaagaagagattaattatggtttggagagagctgtccattcataactggcgggctacagagggcagaaatcattccccaatgggagaaattgttaagagattgagtgaactccaactatgaaggcctatcaacggacagaaggcagggcgtagagaatgttgtgatttagaagttatacagccaagtaccttctaggtacacctgtgctgtcagactattagaacaagagccaattcaaagttctattcaactttgagacttaggctgccagtattcccaccaggtcacatttggctaagacagctttacacagagaaatgaaggtcatcagcataaagacagagatgttcagagcttaaggaggaaaagtagacaatatcatatgaggacagaaagaggcacggggatgcataacactgtattaagatgaatattacaaagctgaaacaaagagtttttaaattctaatttgcatttccaaaagttatatgcacagatacttgcactgcttcatttcctctctacatgggggtctgggtggctatctggaagaaaagaaaaaagcttatcaattttttttttagtgccctattgaacacatcactgcattttaatctgggacagatggtggaaaatggcatctggttaatcaggggttcatagattatttggtgatacaacttaactgtgctgatgaagaaatgagaaattttgtctcttccctagagcagcattataaagcatccttcctggtgtttaaaattgattgtgcattctattggttaaagagtggcattttgaaaataaaattagggctgatttgcatttgtgttgaaacagttgcacaggcatttgataagaatagttcttttttcttttagaacacatttacagtttgcatttatttatattaactcaatgttttattcaacattgttttaaaagacaagacaaacatggatataattactcataaagaaaataactcttatgagtgagaatgattactatgtatttcatttgggaaaataaaacacaattttttttattaataaggacacaggcaatacttcagtaaatgtaccaaggtaattcaattttataacggacaattttaaaaggcattttgaaacattatatattattaatttttacatctagaattgtacttgtagatgccatcagaatactcgatcaatatctgtttattcagatttaagctccatgacttagttgcattacatttaatttatgtgtatttccttgattcacagtctgtagtaaattctgattgcttacacctgggcaaaatgtctttaaaattgtcaataacttccaggcagtaaaaaaaatgaattgcatgttgatggtaaaagaaaacaaactgctacatgtgatgcatgcagatttattaactaaataagtcttcattcctcctccaagtatgattgaaatttatagtcttgctagaaaactctattttccaagaaagtgtttgcaaagacatttgtacagtaattaaaatagttacttttccagtaattataatagggaacttggaaatatgcaaaataataatcttattttatttatggtatatcatattatctttgaaaagcaactcaggtgacatgatgtttaaaagttttaatctcctaaatgaaaaatatgttgctattgtagaattggtcttgtaagatggtgtcagagacaaaaatcataggaaagttcatagatttttttaatttttaagttatttcacgtaaatcatcaatggactctaggaagacataatccctcccacccctaccacacacacatacgaaaaactttacattttaaaaggccaggcaaatactactgagacagagaaatatatagtaagcacctggttgtaaatttaaccataaccatccagaaagatcagttataaaatggacattctgggctgagtatcaatggttacataaattgaactttgtcaggaaagggagggaactgagtttctaagtgggccagaggtgaaaagcaggttttgtgaaacacctagggatgctgcagttgaatagcctgcaattggaaggtagatctaagaagtaaaaatactaaaaaaaaaaaaaaaaaaaaaaaaaaaaaattaagatactactttgttataaaataccttgacgattctgtgctgatgatacatgaatcagcctcctcccatcagtacagtgaacttggtcaatgaactgactctaatgtgtgcttctttgccccaaacagtcatagggcagaaggtctaagctttagaagttgaatcctatgggagagggcatagcattcatgtaccatgacagacacatgttcattctctgccccataaggggcaaacaccattctgggtacttagggcatgaacgtgaaaaaaatagaccaaagttttgaggtgtggggtatatattacaagaagagaagagagagcacaaacatataaacaaataaataaacatgttccagatggcaataaattttataaaaataacaaaacagggtagggaggatagaaaatacaaggatgctattttagagaaggtgatcaggaaagatcttccaggcacagtgacatttgacagagatgtagaggaagtaaaccatgagctatgtggatgttctagggaagtgtactactggcaaaggaaacagcaggaacagctcggagagtttctgtttaaggaccagcaaggcaggcagcaagtgaggctgcagggctgtgggcagaaggaggatgatggaagatgatggctcagagctggtgataacaaagaggcgagatcaatcagaaccttttggccgctctaggaaacttggcttttcttttcactgaggcaagaggccactggacatttttgagtagagtgatgtgatctggtttctcttttaaatagcttattttagctactctgaggaaactgaaaagaaggaagacaacaacaagctgttgcaacaattcagaccaagggtgctaagagtttggaccacattgctaacaacagtagtgagaaatcagtgcctattctgatgtgagtcaatgggatttgctgatagactgggggtagtgtgtgataggagagagaagtgaagagaagtaatccatgacgccaagttttctgatccacataattaaaaggatggagctaccatttactgaaatggagttgataatgggaaaaaagtaaatctgaagtccatttgggggccataattattttgagatacttcttagctattcgtggacagatcaaaagatgtgacatgcttatcttgaaaaaaaaaaaaaaactaaagaatgaatgaactagaggaatatggtaagattaccagataggcctaaaaatcaccagagtttgtgaatttcctccagtggattaaaaactccaccagaaataagaacaattgagttagagcaagaaggtagggatgtttggtgaagtggttaaggtttggaaaaatacttagaaatattttatcttctaaacattataggggtagggatgttatggccaactgtgtggcttggaaaagttccttaattaattctcattgcttctactcagtacgcagttcttataaatcagagagaacatctctttcaggttgtatcaggagcattctcaaactaacactcataaatcggcaatttaggcagggaggaaaggaatattcaccgattacctgctatattccagacaccgtgcatgccgcttcacacatattatcttaattgatcttcccgacacattttcgatgtggaaactcttattttcattttagaggtgaataaaggttaaaggttaaagattcacctacttaacatagctgggcagggatagagcatggaatttgccttacctgccatcatttccatctgaagaagttgaaaagctgtctccaaatattttggtatgagatggggtacataaatacttgttaataacttgttcgactgcattatgtctagacaagaatatattaaattcggaaaagaaataattttaggagtgtaagctttatgaggatttagtccatgctgtcttatatacaggtgtattctattcattcactcacctaatattcatttggtgcttacaataggaaaggaggttttttgtttatttgtgtttgcctgtttgagatggagtctcgctctgtcacccaggctggagtgcagtggctcaacgtcagctcactgcaacatccacctccctgtttcaagcaattcttgtgcctcagcctcccgtgtaggggggactacaggtgcgcgccactatgcctgcctaatttttgtatttttggtagagacaggctttcgccaggtaggccaggctggtctcaaactcctgtcctcaagtgatccacccacctcagcctctcaaagtcctgggatcagaggcatgagccagcacgtggggctaggctaggagttatgtgctccatagttaaataagatacagttcttgttcttgagaatttcctattttatatatatagacagccagataatagcacactgtttctactttaaaggctgcactcctcttgcctgtttaatattcaactgcctataatccagggctttgcaaaaaatcattcactgcttttttgcagtgatcagttaatcaagcagagccacaaagggactcaagcaagggtagtagaaggctggcttctggaatacaggaaaagcctctgtttgccagagcccaaggttttaaatacagacaaagtcaaaggctgggaagaaagcaatgtgcgctcatagatagcatggacccaggagatcagccccagggatggagatcagatggaagccaacattgctggtctaaatagaggcagaccaagtttagaaattgaagcacagaagttcaactgtttcaaagagatttactgcagctttgaaaaacacgaactgaaaatcaggggtgagtgtggcagggcccacaagctctcaaagaaagagagggaagcgctaactgggcagcttctttggcttcttaggctttagacccttctgaagatgctgtatatctttctctatcaggacccagggaagttgggttgttccctgggaatacttactgctgcaccaggaggaagagacagctacagtgccctaagtccccagctccagtagcccttaaggatccctggtctacttcagctcctctttcgaagctgcctcactctgagtagttttttctccctctaagagaggcctattacccttgctgctgctgctggtggtggtgggggtgtcctagatttgtctagttgtttgagtttgggggctagatcttgtattggagttgaacttcaactttttttaaggggcaaggctcttgactgaaatttctttggtaaactcttgttcctagaaaaaatccagcatttggctccctttcattgaccttttcattctgtggatactaagcctcattgatctcccagctagattcacatgccttgggatattgcctggttctaggagggacagtaggtcatatcatgatagcagtggatgagcatggtgctgtgaggctggctgaagtggccctcgataaaggtcagaaacaataggcagaagggtacaccatttatacctactggtaaagtccattggtagcccatggctggacagaaaagcaatagcccctttcagaggatggaagttaaagtactagttataaaactaaagaaaatatttaggccactggaagtaatggttcattatgattattaaaacaacaatgacaacctgcaggctaaggatgtctttaagatattgtagaatgcctgagtagataaaatatgaggcaaaataaatggcagggaataaatggatctgataagtggatgacttactatccaagatgtagcataatttccacaaggctatattctaaaatatgcagttaatgccataagcacaaaagtataaaatgcactgggatctcaatatgccaaatgcactttagagtccagtgggcttgatcttgctgaggatggccatgcctcaacagattttagtctcctagaccttaggtcatttgtattatctgatagcataaaggtatgtggcatcatggaatgagctaagtaccacattggagaaatctccccggatacccaatgatccccaggacatttcattctgttcatatcccagtaccagcagaagacagagcaatctcagatgcagcctctgccaatctcgagattccttctgccagatctttatgtcatctcagaagaatagtattttttttttgtatccttgtcctagatccacttcacactgtgttaagcaaagtggctgagaaaatgcagagttatttcaggctgagacctatatcggataatcataagggctgtgtacaccataggatggaattcacttgctttatttttcaacatttaacacagtgaaagatttaaacataaattatttgattggctcactcacttacttgcaaggaagctcctgaatcactgtatgatccccatgctcccccaaccaattcctgaaacttggaaccgaagcattattttggaaacaccaatgcaacagaaatacatgctattaccctggggccagtacaccttattctgacccatgcttccctctctctaggattgctctccacggggaaatgtatcttgttctttggccattctcatgcagagacactgttccttccccatgtacctgttaggattcagaacaagaagtcacttaactctttttacgtcgaatagttaagagtacacaattattcaggaaattgtaactttgatgtatttaaatataagaagcatctgcttggaatctgacccacgtttgtagttcatgggtcaatcagaaaattaggcagggttttaaatgatgttttcactgctctgcaaggtgcaggctaaaacctttcctcttcactcataggtgggaattgaacaatgagaacacatggacacaggaaggggaacatcacattctggggactgttgtggggtggggggcggggggagggatagcattaggagatatacctaatgctaaatgacgagttaatgggtgcagcacaccagcatggcacatgtatatatatgtaactaacctgcacattgtgcacatgtaccctaaaacttaaagtataataataaaaaaataaaataaaataaaataaaaagaaagaactcacccagtgcagctcccttcttccaagtgttgactcttctccagaatttgcttgcttttgtctctcgccagtgccttcaggtggctgttttgtagtttttccagcatttatagttattttctttgggaagggcagtctgattgaagcttattcacacattttgaaggcatccctgaggaaacaggaagaaaaatttgcactgttaaccctttgccttgcgatcaaaaagtttgtaattattatatacatatcctttcttggctttgattcttttgtgatatgtgtgtcagaaaaaaaaaagaagaaataaaagaaaggcaagaagatgaatggaagaaagagataaaataaggcttttgattaatgtataatgacatatccacaattacagtatcaggcagaatagtttcctgttcctaaaagtttcccattctctgcctattcatcacttcctccctcctttcaaattcatgacaatcattcatccttctactgtctccatagttttgtcttttccagaatgtcacatatttggaattatgaagtatgtagccttttcagactgacttcttttacttagtaatatgcacttaggatttatcaatgcattttaatagcttcacagctcattttcttttagcactaaataatatttcgttgtatggatataccacactttattcatccattcatctcctgaagggcatcttggttgcttccaagttttggcaattataaatacagtgctgtaaacatctctgtgcaggtttttatgtggacatacgtttttaatttatttggataaacaccaagaagtgcaattgctggatcatacggtaagagtatatttagttttgtaagaactgtcaaaccaaatggtacagtggctgtaccattttgtgttcccaccagcaatgaatgagagtttcagttgctccacattcgtgtcagaatttagtgttatcattattttcaattttagcattctaccagatatgtagttgtatctcattgttgttttaattctcaattccctaatgacatatactattgagaatacccacaattttacaacatggtatactaccactgctgccattacttgcaaacacctagttaaaactttctatgtactaggcactatgcagagtacttttcatatattttctcataaccctacgagtcagatacaccattattatgcattttcaggaaaaaaatcctgaagttgagaagagttaagtacactgctagtaaatgttgaatctatgacgctggggtctttctgactccaaatctcatcttttaaccactacatacatttttcctcaaagtgtgatcccgaatcccatacttcaaaccaagcaggatggtgataaaaattcagaattctgaattgtaaaatattgcattagaatcttcatgctgggtgtggatctggagtgggagaaactgaaacacactcaagattaagagccattatactaccattctaggattactcgaagtccaagtagcagttttgatactttgtttctatcttgtatcatgtatttctctttgaagtatatttacaaaatccctgttatttatataaaataaattatactaaaaacattgagattatatcttaaatgtaggtgaatatatagttttctatgttccctaattaaggatgctataaaatcttttcctcatacactctaccttagagataaatttgacaacaggggaaaaaaaaaaaacaacctcgagtctttcaaatatctactatgtatcattctggtatagtctgattgtatcctcccaaaattcatattgattcagttgattcaattgaaatcataatcaccaagttgatgatattaggaggtggggtctttgagaggtgattaggtcataaaggcaaagccctgagtggaattactgttcttataaaaacactttagacaggtagcttgctccttcccacatatgaggacacagcaggtgccacctataaactagaaagtggaccctcgccagactccaaatgtgccagagacttgatcttagacttcacagcctgtagaactgtgagaaatcattttctgttttttataagccacccagtttatgacatttttgttataacagtgcatagggactaagatatactttgtgctaggtaaattgaacaaagatcataccaaatacttctagcattatgacagatttatctaactataaaagtctatttaatgtcgttttattggatggaaaaactgaatatatttgcatattttactatactatatatactatatatatgcatatatagtgtgtgtatatatatagtattgtatatatgctataccatagtataccataatatactacatatatagtatatttcacgataatttcaggctaaggaaaaagtcattattgcaggcactctatgaaaacttattaattaaaataaacagacatgtttttgttgtggcttttgatccaagacaagacattattaaggatattaacaatagaattgcctgtgttcaaatctctgctatgcttctaagtcattgtggaactttgggcaagctttagtaacaccttttaggtcttggtgtacaagattctaaatggagataaggaaagcctctacactctagaattattgaattaaaggagttagacagtgcctgattcacattatactttcaataaatgtgagctattattattttcattattattattctcaaaaacaaaaggaaattgagtaacagagtggtagagtggaaagcgtggcagaatggtagtgtgagacccaaaaatataagaatataaatgatatgtgacaaatccatagtgtagaaattgaatactctgagaatgaaaaactgaagaaatcacttttcatgggagtgggcagggatgcatggcttctttgaggaatctaaataaacttgaaaatgtttttaggtgaaaagaatgtgtatttggagtggatgtcctcagggatgtacaaatttagagactttagctctttttggtagatagggaaaccccgtttggaccctcagacacagcccactgtgtcaagacttggcaatttgaggagagatggtgtcaaggtaggtgctgtataagaaaggaatcttagacacatgaagagaagccatcctttcttgaaccccatttgcagctacaaaattgcagactgagtactacagtcttttaaacaagcctgtcactgagttcacaaaggcaagaggcattgtcacctgaagccacaaatcctgctaagagcattaattgttctctatataacataggctgtttagttctgcaatcaataagaaagagtgggctcagatcaggacctattgcttttcttcaggtaaacttggaattcaacaaatagaccacaatctacaattttctccataaggcagaatgcaggctaagttgatacatatttacaagcatggaaatgagttaatgaccttgagatgaggatctcagtgacataaacccccattctctttacaacttcttgagtttgtcttggtgtttgctaactctgaggaggtctaaaagaataaacagtgtctgcattctgctttcaatgccataaacacattttggagaggcaggagcaattttatagctgtacatacactggagagagagcatgaccctggagagctagaggtttatcatcactttaaaaaataatggttgagaaggaattgctctaagtgtagtctctgtcttttattttatattttttaatagctacctcttattgagtgtttactaagagacaagaactctattaggcactgtttaaacttttattttaaaatgaaacacagatacagcaaaccacacaaaattattataaggcaaataccatcttaaccgctacgcatgtcaaagaatgaaatcttgctagccatccagaagtctctatacattctctgtcctctctgtctccaaaaataaccaccctcttgactttcatattaatctttttttgcatttttattgtttaccatttaagtgaacatcctaaggcattataatgtcatcaattttcaaattgatatgtcttttagcttcaatatcatcaatgtgtcatctcccttgttcccacaaactcctttcccttaaaattaatctgttgacaaatatgggccacttgtggattttaccccagggtggatttgatgagtatattgatatactcatggtgccaatttacatgttcttctcttctctgcatttccagcaagtggcagcaggaaccttgatcaaactcagcttttatattgtttgcaacactataggtagcactgaatctttcatcaggaggcaaattgatgctcaacggcagttggttattttcttggtgattataaaatggtgatactctaattctatccattatttttacacattagctcaaataatttcatatgtaaggtaattcttcctttcacctacaatttggttacccaggggcataactccaaaaaggacagaactgaagtttttatgataggttttgtgataataaattggttccctatcatcctcatcaattaggatttaaatttatctgatggatcccaatgcactgtaatttttatccttattgaagtgctattttttccttcttcatccaggtggaggcttttcaaggttaacttttgattcctcttgaactagtagtctttgatacttcccatgttagttcataacaaaatgtttcagatttatctggtgtgctccttttcttatatctgtattcagcacttttctaagaaattctgttttgtttgtctgtttgtttgtttgtttgttttaacaccacaacctggttgcaagtgatagtcattgctactagggttgccaaagttagcacataaaaatacaagccacgtagtcacctacttgggacatacttatactaaaaaattattcgttgtgtatctgaaactcaaatttaattgagcaccctgcattttatttgacaattaatttatactaggtcagtcattatttttagaccgagttaatctaggtcctctgagaagcaggtgcaagtggatgtgcaagagagttattggagaaaatgcctgtgagggaataaaagagtgaatggaaaaagcaggaataaccctttgactgtgatgtaggctttactgctgtgaaggtcaatgggaagaaaggagaatagatagaaagagtctcaaactgtagttcaggtctaagaaatatttaggagggttctcaaaccaaagctgtccaacggaggattcccacaagccctatgaaggggactgcttcagtatctctgccgcctgcactcagtcattcgcctagcacaagctgtgggaagcatagcctcactgctaatgctgttgtgcattaggaatgagataataatgatatctccaaatgaaaatgtccaattcaatttcagggctattttctaaaggaacatcttctatttgcctcttatctatagtgaaaattatagttcttaaagccttggcgattagagagttagaacatctcataattactcatttacttttccaatattatacacacaacagaaaaaaaagtaactatacaaatattaccaccacccattataattattgaaaatatgttttcttgcatatgctatctcattctctccatttggttgtactaaatctacattggtagataatatagctgttatgtactctttcctacttaacactcaatttgtcttattctactatcactaaatgtgtaatccaccataattcttaggcttatgtctctccagttctggaatgttcgcagtggctcttagtgacatgaggtattggacaattgaaacatgtctggtctaaattggtatgttcgtaagcataaaatacatactggatattggaaatttactatacgatgtaaagtctcatagacaattttcatatatattagatatcaaaatgataaaacgtttagtgtgttgggataaataaaatataccattgatttaaattcttctgtttctttttactttcttcaggtggctactaaaaaatttaaaattacacacttttttttatttaatggcgatgttcctgttaattttgttttctaaaactgatttctagaagactcctcaaaaaactcccacgaggacaatattccttgggtgattgcatgttggtaacagtctttctatgaccgttataattgaaattcagttttactgaatataaaacctccggtccatattgtcttttcttgaatgtcttaaatatgttacttcatttttttctctctaagataaagtgttactgttggaaagtttaataataataatcttagttcctttttaactcaagtattcttttgccctacatgcccaagtaattctttttttcctctttcttaattttacttcgtgttgattgtactacgttaatattatcagttacactatgagatttttcagtaagtttaattgatttttttaaatttcaggattactttcttatactttttttttttttttgagacagagtcttgcactgtcacccgggagtgcaatggtgtgatctcggctcactgcaacctctgccgcctgggttcaagtgatcctcctgcctcagcctcctgagtagctgggattacaggcacctaccaccacacctggctaattttctgtatttttagtagagctggggtttcactatgttggctaggctggttttgaacttctgacctcgtgatccacccgcctcggcttcccaaagtactgggattacaggcgtgagccaccgcgcccagtcagtattgaattttttttttttttttttaaatccttgctttattctctcactcagaaactcctataacattcatggatctttttgccatctataatacatgtcacattttcttgaaacctctttctttattttttaatttctttttagtgttaaatatttttctccttctcaacttgatttcctttaaagtgttatttttgtacttatatcctcttattttccttctagattagtcttattcctactatgctgtttcttttctttctaattttttcttgagtttgatctctttttctacttctgattaatgtttttttcatgtgttgcatgatgattttcttaatgtcctttagcttattttaaaataatatgttacacttttgaaaacattttgagcatgacattttttggcaggcttattttgtcaatagcagaagttggtaaatttcctgtaaggttcaagacagtaaatattttacactgtgtaggccatatggcctgtcacaaatacttaacattgccattgtaccatgaagatagtcataagcaatatgtaaatgaatgagagtagctatgtaccaataaaactttatttctaaaaacagaaagtagactggatttggcctctgggctacaatttgccagtctctggtccataggaatttcattctatgtttccttgtagcaactttgttttgggggctaaactttacatacatggcatttgaccttgatagttttctgttgctcatttttgtataaatttagtttttttgaacttttagataggtaaaatttaagactgacttttcaacctaaaggagatccttcttctcttgttatgtaacagtaaaaaatagatatattggcttgttttcatagatttcttatatctgtttacctggaaacaggtttgtctggattttctctttcctgcatttttattatgtctattcagttcaattttgactccacttctagtagtttatcctcagtatggggtcctgttttggaaagatgcctggaagtttggtttcaagagttcacaggatctagactgcaccagccacctaagaccttgacatagacctgctaagaacaacgaaacagctgagattttatactgctttcgagctaatgagttaacccgccaggtttatggatgtcggcaaaagacatgagactgagggtcagagacaaagactttgattactcatagtataatgagtaggatgaacatgaacgtatttgtgtgagttcttcttctcctcaagtaccatgggaggggtggttaagccagatggatgcctacccacacagtagattgcagtttatagaagaggaaccctgagcttaaggaacccaaatcttttataatggggagtaagcatgcttgttttttgttccagaggaagacattatcttttttatactgaagagtaataatgcttgtcctttgctccagaggaagatactagtccttctttccaggttaattgctgcacaaatattctttaaaagatattatgaaacagggtattttcttctgataagaaatgcagaaatatgagggaccaatttcctgttgggaaaggggctccccacagggcccattttacttactgttggaatgcacaaaacctctcctagttccactcagtgttcttatgttggtccactgtagtttctagtgaatatgcattgactatttgggggttcctttcttaaatattttggaattatcacaactgtaatttgccctactgctttcttctgcattcgctcacatagacacaagggcacccacactgtgtggcttttggtgtttacggatttgcataggtatctagttatttagaagtggtgtaaatgttgtacatttggttctgatatctaactctctatctagcctaaacccatgctgtcatcacagcagcctatcttcccaaaataaccctttcaaaaaaagtatgccaagcctgattttaccttttttgaagtcctcattttgagcataaactttatttttccctaaaatacttatatttttccctaaaatacttatttctaagatcttcctaagttgcataaaaatacttgtctctcctacccctcccccatactaagtggtactaagttgttattattttaagtggaggggccagtgttttctttctttgctttctataacattctgtatcttattttcttgctatatttgtataccccatctatcagcaattccccttaccctctttccaaatatgttgtcaaaaactagcaaagcagataaacaagcttatttaatatgtgtgcagaggatgtaaagcaaaaataactatcttctgagattgagcataatcttagaaatttctattgactttatggtccttttggcagtatatatagtctagaggaatttaagctgtatttacaacaacaaatattttattcaatttcaatatttcctcagcattttgcccattatagctcttcctcctccaaatttagtatagtgtttatatattaggtaagaaataaattaggagtgatagtgcaaacataattctctccaaattctcctgtgagctctccacactggaagcttggtacttcataacacgtagtacctgctcctaagcagtagaaaattccatgcttatgtggcttttacttaatgttttagaactaagcaatatctgatgggttcttactcatatccaacatcagtagatcagatgctgatatgatgaatcttgataagatgaatcttgatattcagaggaatatcaagactatgtaattcctacatgtcaagtagagaaaagtaaaatattctgggacaacagaaagagaaaatatattttccctggatgatcctattcagtaaaataaaaaatacaagattataggagatgctaatagagcttaatattgagagggtgaataaagatttttttttcaaagagcatttcctctgaggctccccctacttaggcaaggagactgatgtagacccctacccaccaccccctgagcacacacacacagttaactccagtccccaacagaattcctctccactaagcattgatattagtagaaaagataagatgccccatatgacaattaggatgctgaacaagctattaggttggtgtaaaaaaattgcggttttgccattactttttttttttttttttgagacagaatctcactctgtcacccaggctggagtgcagtggcgccatcttggctcactgcaacctccgcctcccgggttcaagtgattctcctgcctcagcttccctagcagctgggattacagtcacgtaccaccacaccaagctaattttatttattttttttttttggtattcttagtggagacggggtttcgccatttgaccggcttggtctcgaactcctgacctcaaatgatccacttgccttgacctcccaaagtgctagggctattatatttaattgcaaaaaccacagttacatttgcaccaacctaatattagaaactaaaggcattcaattgtgcagtgagatagacactacaaagagtgaaagaagaaagtccctgtgaacttgcgatgggaaggttgtgaaaggtgttgagtcctaatagatcagttatattcgggaagatgaaaatgtgagtggatggcttctccatgtgaaaggtcaggggacccctgaagggaagaggactgcccatttgtcctgtgaggcttttgatgtcctattaactaagattaaacactcttataagtgttgctcagtaaatcaagttgctaactgaagggtgattttctagtcattgatatgtaagaactatcatatctgtaatagattcctcctcctcctctgatgcttacggtctaattgttaagtgtaacaaatgataaaatattacaaggcaaggtaagcttgaaattaattagtaatatcaagtataacttactgacagaggaatgaggaagttacacttttgactgcattctaaaattatacaaatatatagaaaaccaatggcagaagcaatatttaggcataaccagtgggatttatggtatttcatttcatgattcttatgaaggtgttaataagccaataagacttactacaccctaacatccctaacaacttcagaatgtattctcttggcgtttcccttccctttttctcctcctactctaccttgtctcttcctcttctttctctttcttctttgatttggataaagatctgtgactttagtaaatatttagatatgcaggatagaaactgagtgacttaaacatttccttactctcccaaaaagatacagatgtgtgacagattgacagacagatgaatataacaagggatatacactagcaagcaactcatcgtgtctaatagatgaaacagaattaaacaatgttcagtattgaaagatgtgttttaatgtgtcttatttcaatgtactttgcctcccctgatatcccgaaactattatttgtataatcacctgactctgcatggtgaaaggaacccaaggacttggcctcaagtttcctttggcaatagtggaagaaaaatccccagtggtagaaagtcaattggtagagacaatgccagggactctttaatgtcagcggatgctctagggctattgcaccagaatcttcgactatctcttgttttctaggggaaaattcatgggagaatttgaatctagtactaaatctttaaaaacaaattgaacattgtggaagtgttaaaaaagatgaaaatctttccttccaaaaattagtcaagatcttacagtagaattttctctttcgatttgtaaaagattttctagaatgggaaatgtgttttgtgctattatgggaattttataaggaaagaaattgagtaaccactatgaagtctaaatctaagagaaggctcagtaatatcgtacttttcaaggaataaaggaagattattttgaatcattagggaatcttgtcttggttatggaaacgagaaataccagattcaaagaaatttattcatcacaggcagacattatctcaaaaggacaaatgcgatgccaatgtttctaaatactcctccatacatagcaacctctgtcatttgtagacaaatctgattgagaaaactttattttatttctaaagagttgtgaaaatcaggaaaaaaaataccattaatatcagctcaaagagatgatggaaggttttcttttttcttttttactgtgccgacataaccaattcattaaatgacaactcttaaaaaataaagagcaaaataaagaaacacacatcccttgttgggcatctagtgggtaaacatgacaacagcaggtaaatttctcacgttctcaagttgttttggtgttacaattcagctacatgtatacagagaaaagcatacacggtaaaataatctgcattgttttactgtcttaattcctgtatatatgacacagaagggcggtggggtgaaaggaagatgtgaggttttaaatatagcaaaaaaaaaaaaaaaaagagagatttgacaacactggacctcagtaggcatgggcaatttgttcaatatcttcaggtctccagagagcaagaatgactctcaggatattgcaactctgtctgcttccaccagagatcataattgggctatgaatttttataacaggaaagtcttcctgtcaaagacagagactgacaaaaactttagttaactgatactgaaagaaactcaaaacagaatgaatagtatacatgagtatcacttatatatatagtgcctttacttctttcttcttttttactttaaaagtaaattcctgttatagtttactggttagagcttctaaaatgtagcttgtttatgaggattgctcagcatactggttttctgtccagggacatgatgtgcattttggggaattcaaaacccgattgaggtgagtagaggtcattcataaatcgaaaccaaatgatagcagaagatatgaactaaagctatttctttatctgcaaagagctaattgggcatatttcaggccaagtctctgaagacacagctcgtgaactctgtcttcttgatgctgtgctcattatagacactcaacagaggactggctaatgctagggaaatccccatcaaggtggtctttacatgacactgcagatttacctcaggaaggggagcaaagagaaggaaaatgcagtgagggtttctagcaactagctgcttgtggagtactgtttgccttgtctaatttatctgaaactgaagagtttgtctctaaagggtatcctacttcagaaaatctcaagggacatttgtctttctgacatatcagctgttagctagaccttatttcttacttggttgtttttagagtaaattttggttctttggtcctttgtctgctatttgaggtggaggattaaatactgcatagatgacctatgtatgtatagaacaacctaattttgccacagataccaaaacactataacgataatcttcaattaatccaattattatctaaatttcataacccgtcctcaattatctaccttaatatttctaggtaaagagagatgtactgcattgacttcctgtttttaaagggtaaaacagcaagagaaagaaagacattgtagatattcacaatgttgtatgtgaggaagtttttgaatggcttcagaaacccaaatgaatatattgagaaagcagcattgtgagttctgtctacatgtgaacccaaaactaggatttgaggtaatccattttcagaaagaagtgatggagtttgaattctaggaaatcttcctgaataaaatggccatgtgttgtaaagtttagatatttataacccaaaatagaaggaattttgctaggtgatctctccagttccttttcagttatgagagtctgatttcttcccatgaaaagtgtagaaaaacttcctttactgttatatgaatgttataaaatgtatgcttgtccatgaattagctgatcaaagataatacatgaaaaagtattcaaaatactctgtgaatcttttttttaaaaaactctctttaaatagatttttgtattcagaagttatgctttgtaaatacattttaaatttcagatttaaacattatcaagacaaaattgtgactatgtgcatgtaaaactagagagcactggaaaatatggtggatggtaagggccttttgcaaggtaattaacttatctattgagttttttttttttaatttctaagtacttaattgactctcccactaaaatttaaacatatacaaataatttttcattcagaagataggcatttgatttataacatcaacatatcatcacaaaaacttagagaatgagaatatcttaatgggcacctggtctaaacattttaattttaccaggtaaaaaggtggaagtggcatggcatggtggctcatgtctgtaatcccagcactctgggaggccggggtgggcggataactaggtcaggagatcgagacaatgccggctaacacggtgaaaccccgtctccactaaaaatgcaaaaaattagcttggtgtggtggcgcgcgcctgtagtcccagctacttgggaggctgaggcaggagaatgtttctttaaaaataacatcattagaaaccatacaaaacagaactgcaaatactcccttctaaggtgtaaggtattccaacatttcttgtttggacgttagaattttttcttcagtaagaaattaagttgaaaatgaagtagaacatcttacactgtaattcaagtgcaatacattaaaaaaataaaaacagtgtttaaattgggaaaatccgtttacatgtgattaagttttaatcagtgcccttaacccagatctcaacagctaaaaatgttcttagcttgacaaaataacaacccatccccaaggacaaatacttaaatcaaagaagcattttataaataaaaaaattcacgcacacatacacacacagacccccacaatacatgaaacatataataatgtttgtctttatttgtaatgaagtggattttatactgaattcagaacacagatgcaaattcaacagttgaactcaatcaaataagtaatcttatataaaaggatatctccctccagcatgtacttatcctgtgtgacagatatctctgtaataaagtaaattccttcaactcaagcagattgtccgaaatggaaacacaatgaaaggatgaatatactcaaataatcaacagaagagcaaaatataaaaatgcgaacattttctgaataatgcagatgccctccctccaaaagaattacatgtgagggaatatctatattgtcataattactggataagctgcccaatagctattacactaatgtttcattaaaaatatatatttgctttatgcttttgcaacttgcaaagttattcctagcaaaaagttatttctcctgaaacagaataaataggtctttcacaatatgcactggaatacatatttttgaaaaacaagatctccactcacctctaattctatctttctgctggtgattactgatatatttattttaaaatacatactttataggaagtatcgttacaattaatatttaggacaacattataattcgtgttttagaaactactaaggcaagaggacagctcctaccattctacaaaagtctttcagttaagaagtgactaattaatggactgagtggctcagagcagggagccagtccttagccaataaagcccaactcactgccaccccactgccccatattctctgtcctctctgctggaactgtcttgtgctgaatacatgaacacctaaatattcaactcactcctgccatttctccggtaagcaatcttccacaacctgtgcctgagacttggaggctgtttgtggtccacaggctttaggcgccctagggaaagccacgtgcactagtgcatctggatgaactgtggactttgtctatccgcggtaattcaacttcctaagagctacattgactcattgatttgtatccaggctccgggctcccaattcccacacaacgtaagctccctgcagccaggggatttggtaggtttgccgtgttgtttagtttctctcccctgcgaccctctctctgagcctcacagtgtgtttggcacgtggtaggtgctcggtaaacctactttgaatgggagagggttgtgttgaagaaaggaaaggctgggaggacttaagatttgaaggttttcctacacgtgtccaggaagaaagaaaaagaaaaaagaaatgagtatcagagtcttatcatcattacagttcttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 1002 - DNA, 780065 bp, Homo sapiens
gtgagtgacatgcaaggaactgacattgaagtaagattctgtgagggtgaggttgcatttgtagaaagtggttatagtccacttagcaatggtcatcacagaggtggctgagggaccagtagatggttctgaaaaggtaagtggatgctacctaggtttgtttagtcttctttctagcagggtttctgattgggtttcatttattttattctcttgtactgaattgtcttttcctatttttcttttttgttttaagcattattcatcataggcctaatagttgcccacatatatttaatgtgtatgtttatattataatttttgaaggataatttgaattattatccatttagaaaatgaccataacatactttcacatttcttgtgctctaccttcttcacctcaactagtcaccctttatatgctctgggtttcatattgaaaatatatttgaaatattcctggatcattacacataactctgtaacatatttattttttaaattctggagaaatctatttttgagctcactagtttcctttataagtctatccatttctcaattcaacccactcatagagttttttaattacttttttcaactaaaaattgaatgtttaaatctaactcttttaaaatgaccactgcttaacataaactgggaagagataagggagtcatggcccatctgttccagtaatcatccagatggacaaccaggtggcctctgccttgcttacaatcattaactgtgaacctggaggactgctacaaccaaccttagcagaagatctgaggatacaaaagtttagggcaccagtttcttatgttcttttttttctttataattcttttaatcttctctttatgtttcagggattcctcaaaatttgcaattggttgatggcactcttcatctttctgatgttcatttagaagtggtatgtgtgcgtgtgtatgtgtgtgtagtgtgtatgtagtcattcttaccagtagtgcacacctccccccccaattctctcctctatcctactttgttcttttgatttttttcatttcaagggattttggaaagtagaagagtaaaattgtatagtcaatctacaccctttgatacaatctccagtgcactaattaattttacatttttatcattgttagtttttattgaaacacgcatgccaaaagaaaaaaaatccacccaagaataattgaattggtgtatctgagtttggtagataatcctttaaatcttaaattgtgttaatctcagcatttgcagagctattgcctgctatcctgtagtgaacccagtttctaaatcagagcaatccttaattaaaatgggacattaatcaacagcaaactatttgcatctaccattattctaaattgtgtgacttgacaagatccacgttattgcctaagataaacattaaatatataaacttcataaggcagaagctgtttatcttagtcttatctagaaaagacattacaaataaggattcattaacttattcattttatatatatgtatgtttttcacgttatagatacgtatattattctttgccaattatattgtaattatatgctttaggattaaataacagttgtaattttttgtcacacacatgcctgcatgtgtaggcactttatgcatatgaacacatttatatttcttatttatacatcaagattatgcaaaaaaatgagaaaaaataaaaatatgaaaatgcttaattcagttatttgtgcaacctaaatataaaattagagcatgcctccaggatctaatgggagtcttaagggtccattagatggcacaattggtttaaaattataatatctctcaaatttttaaaattaaaatttgccttcaatgtaaagcaatggtaacaacaaactgttagaataacatatggcactaaccaaattgattctaaatggccacctgtccctaatatctatgatttcctccacagataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttcagcatacaatgtgatgttttaatatacatcttcattgattaccacagttgtgcttattaacatatccatcacctcacaggtttacatattttttttgtggtgagaacatttaagaatactctctgagtaaatgttaagtatacggtacagtataattaatgataggtatggtctattggatttccaaaactaattcattctgcataactgcaactttatgtcattttaccaatgtctcctcttttccctcactctcaagacactggcaatcatcatttttctctctgtttctatgagtttaagtttttaagattgtatatgtgagagtatgctgtatttgtctttctgtccctagcttatttcctttaacataatgttttctatggtcatccatgttgttgcaaatgacagaatgtccttttttttgtttgtttgtttttgtttttgttttgagacggagtctggctctgtcgcccaggctggagtgcggtggcgccatctctgctcactgcaagctccgcctcccgggttcccgccattctcctgcctcagcctcccgagtagctgggactacaggcgcccgccaccacgcccggctaattttttgtattttttgatagagacggggtttcaccgtgttagccaggatggtttcgatctcctgacctcgtgatccccccgcctcggcctcccaaagtgctgggatcacaggcgtgagccaccgcgcccagccagaatttcctctttttaaaaaaagaaaaatggccgggcgcggtggctcacgcctttgatcccaacactttgggaagtcgaggcagggggatcacgaggtcaggagatggagaccatcctggctaacacggtgaaaccccgtctctactaaaaatacaaaaaattagccgggcgtggtggcgggcgcctgtagtcccagctactcgggaggctgaggcaggagaatggctgatcccgggaggcggagcttgcagtgagctgagatcctgcaactgcactccagcctgggcgacacagcaagactctgtctcaaaaaaaaaaaaaaaaaaagaaaaaaaagaaaaatattcctgtgtgggtgtgtgggggtgtgtgggggtgtgtgtttttgtgtctgtgtattttctttgtctattcatctgtctatgaaaacagttgattccgtatcttggccattgtgaataatgctgcagtgaacacaggaatgcagatatctcttcaacatactgattttatttcctttgaatgtatacacaatattgggattgctggattatatgataattatttttaattttttaagaacctccatactgtttttataatagctgtaacaatttacaatcccaccaagaatgtacacgggtttccattttttcacaccctcaccaacactgattatcttttgtctttttgataatagccattctagccattctaacaggtgtgaggttattgtggttttaatttgcatttccctgatgattagtaatgttcagctttttttttttcatgtacctattggccacttatatgtcttcttttgagaactgtctcttccgatcctttgcccattttttaattaggttatttgtttttgctgttgagatctttgaattccttatatgttttggatattaatctctcattgtatatatggcttgcaaacaatttctcccatgtaggttgcctcttcattatgctaattatttcctttgttatacagaagctttttagttgatgcaatcccatttgtctatttttgattttgttgcctttgctttggggatcatatccaaaaattatttgcccagaccaatgtcaaaaggggttttttcctatgttgtctttcaataattttatagtttcagatgttacattgaagtctttaatctattttgggttgatttatgtagacagtgtgagataagggtacaatttcattcttctgcatttagataagcagttttcccaacatctttattgaaaagactttccccattgcatgttcttgtcatctttgtcgaagatctgttgacaataaatgtgtggatttatttctgggctctctatacaattccattgggctgtatgtctatttttatgccagtatcatgttgtttttattactatagctttgtagtatatttcaacatctggtagtatgatgccttcatcattgttcttgtcaggattacttttgactgtttggaacttttgtggtttcatatgctttaggatttcttttgtatttctgtaaataataccattggatttttatggggcttgcattgattctgtatttgttttgaatttttaacaatatagattcttccaatatataaacatagatttttttgtttatttgtgtcttcttcaatttctttcatcaatattttaaagtttaactgtacagatcttttatctcctttgctcaatctattcctaaatctgttttaaatgatactgtgaatgggattgcttccctattttcttttttgggtgtttcattgttagtgtatagaaatgccacagatttttatatgtttgttttgtatcctgcagttatacactgaagttgcttattagttctaacactttttcaatagagcctttaaagtttttccatatatacagtcatgccatctgcaaagagacaatttaactttttcagtcaagattgtaatggatatcctccagactgttcagttgtttccttacagaaatcacagttttaccctcagtaatctcaatacaattacaaagacaaataaaaggatcagtatgtctttgattttgttggaaatacattaactcagcttttactcagtttagcatagtggtaagatgtacaggttttgacattagacagatccaaattccaattctgcttcctcgaatcgcgtgctgatgaatttaggcatgttacttaacctctctgagaatctttcctttctttttttttttaatttggtgagtgagcataataatcacaataatcgaataggctatttttcaggtctatctatatatatatgtatacgtatataatatttatatgtatgtataaaacatttagcgtaaaagcattcaattgattttaatctccttacctgtaagtgtttattttggtgtgtattaacacattgtgtgtatgtttatatagtgtctgcatttaaataaaatagatttaaacttaataacctggaatgctagatttatatcatcacaatttattaggttaaaatgtgggtgctctaaaacaaacaaacacaatgcaacccctcaggctcatgaaagtaaaatgagaaatacattatgtggtgataagagctaatacttcatgcaaatgtgacattacacatctctttgtgtttaggactatgcttgtcagctatgcaaatgctagccattatttcttaacacactctggtccttaaatagcaccaagaggaatgttctatatttcactcatttagtacattattgtattgtaatttttaaataaaactaaaaagaactagaccacataaccatctttgatcaatgttcagaacaaatatatggcagagaattattaaacagtacctcaagcatgctctttccagagggcaatggattatttagtaccatgtcaaatcacataaactaattcaaaaatgataaattacaatgaaaatgcatgctgatgttttgtccctgaattctaataatgggtgtaaaacagtgttaactgtcattgatcagacacatttattggcatgctaacctaacaattaccatagtattgactatcaaacagccatatgattatagtatatgatgtactatatagtatatgattatagaaaagatatagcatatgggttcatttactctaggaataccaattataaatataagtaagtgtagaatactaatttgttaattaaataaatatcattttaattcacaacagttgacactctggttctccttgactccctgagttttaaataagaaaatgtattaactaacttagaattttctcaaatttatttatcattgcacttagccttcacctaataaaaatgtttatttggctttaggcgtgaaatttcccagatagtcaaaaacaaatctgccaaatcaatgccaataatcttctaagtattttgaatattaatatttatgaaggacaaaaggttacttttgtaatgttgcaattaaatgtctattttctcttcataaatagaaattaatgaatcaatgtttatgcaactgactgcttgccaattaaacacttatcttaggaattcataaacgtcctttctcttcaaagagtcagcaatagaaaattctttcttttttctcttttttataacctttcttctacctacttttttcttattctccctgcctatttcttgtcattctctttgttctatactcttttttctttgctctacatcctcctccacgtcccatgcagtgtatggtgttaactcatacaaagcagtgcatgtagagactatgttattaaaaccccaggggtttggtctaggttccattgctcactgcacagaaagccaatcactgagacaatgagtgttgcctgggaagagagatgggagccaaagctcaaatctatccctctcacccaagcaacattgggggtttatatatcagggaaggaatttagctatgtacagaaagcaatcatgacaaatgagggttctggcatctgtctggattcggtgatcaggtgagtttctgttccttccttgcctgaaggttaatttccctagggaggaactcagaagtgagtttcaagttttaagaccagaaggggcaatttctatatttatttaaaaaaaaaaaagtaaacatgagctctacggagcatttgggcttgtttcagcagtaggtgagggcgtggctgaggcctggcagggaagcgatgttcacaatgcctgatcaccttagtttaaaacatttagaagctgagaggaaatttcctggtcaataatctaggcacctcaaaaaagtttccattatttttttttcaaatacacagataatttcttggccaaatttcttggcaatgacactgaggcaagaccagaaatgaatggcttgaaagaatgagaacagcaaagaagaattgtccagttgttcaaatgagagaatttcagcccacagttgaggtaatgatagcagatctggaaaagacagggacgatagaggaaactataaagaagagggacactgtagaattcagcaataggttgaagaaaagacagaaatgagtcacagattggaaatggaataaatgcacattgatgccttccttccccactgttttttttaaaaagcacatatatcacctgatggttatctgaacgagagcccgactgaagaggctgacaatcagactaagccaagcagacaagtaaaatagctatagggaacagtcctagaaacaggttttacagtttagcatagatatgtcttttttcttaaaagaaacaatcttggcttatattttattcataaaagctattctttactctgttgccttgagtgattttgcctatgtgtagatgtgagtacagcagctttaaattcacctgtgcccttgaaacagcagcctgtagtacattcaacatcgttgcactgactgctgctattctgccttctttgtgagccaattatgaatctatcttcagaaaattgtgctccagtgctattactgaattaacactttgcttaagtgtgttaattcacagacacccacatgtgtgcctacatacaacctcagagaaaatgtgtaaataagtttaagagtagcaaaaaggcatgctttttatgaaaagcatttaaagtgtctaaaattttctatttatcctgttaagagagaagggtgcagggatttattaatattgaatgaaatgatgtatattgaatagaaaatatattttctttttttttgagacagagtctcagtctgtcacccaggctggagtgcagtggtgtgatctcagctcactgcatcctccatctcctgggttcaagcaattctcctacctcagcctcccaagtagctgggtttacaggtgcccaccaccatacccagctaatttttgcatttttaggagagatggggtttcaccctgttggccaggctggtctcgaacttctaacctcaggtgatccacccacttcagcctcccaaagtgctgggattacaggcttgagccactgcgcccagccagattatattttctttaagatagaaatagtaggcataatcttcctgatcttcctgattttgtcttccatgttaaagaacatttattgtctgtctaaaatttaatgttcatgtgtacatggaatttaaagacaaaagaatacattccgaagaaaaacttaacttgtatttccaagtcctatctttacatcagaacaccctgtagagctttaaaagttctaaaacctgaattccaccttgagaagttatgtttttaaaatccccactggtcaattgcatgcatagccaaagtggaggatccctgtattagggcctgcctgtcgctaggcgcagggggtggcagcagggcacagtggaggtgggtgtgtggtggaaatcacttccaaacttacctagctctaagatgggctgttagagggcagttccttctaaactttaaatctgaaatcaactgttcagtttatgattctgttactgtataaccctgaccttgaatttatctgggtcacctttgctttgagaaaacagcctgtctagaagagcagggattttgtaatcagagatttgaactgaagtcttggctctggccatttactactgagatacttaggtaaattactgaatctcttgtaacatctgtttcctcactctataaagtagagtgattaaaaatatactcaacagttccaaggctgttcaagttcaatgaaagataatctgtgtaggattgaacacacaggaagtgctcagtgtgcgttaatttctttctcctttactgaatggtagcttttttatactcatttgtgctccttataaaataggcaaagttaagggaaagtgattaaaatcacatgagcctgttctctatttggctgtatctctgtaaagagtgagaagaaggttggctgttttaatttttaagacagaaaaatgattttttgattttgttttgatagagtcttgctctgttttcctggctggagtgcagtggtgcaatcatagctcagtataaccttgaactcctggattcaaatgatcctcctgccttagcttccctagtcgcttggactacaggcacacaataccatacccagataacttttttaaaattttttttcagaaataaggaatctgcccaggctggtctcaaactcctgacctcaagcaatcctcctgcctcaacctcccaaagtgctgggactacaggtgtaactaccaaaaacggcagggaaatgatttttttaaacacacatagcaaaatgtttttgtcttaatatgtgatgcccaacttaaaatagttacctttaagagctgagaggttattccaaagatgctgcactgaaaaaaacattcatagccacacgtatgaaattgtcttccagaatttagggtacgtgaagcaggatggaaatgcaatcgcaaggtcctagggatacaaacctgggacaaacaagcaagtttcctgactctatagaatttacctttcagaggtagacagatgttgatcaagtgctcctacagaaaactaggacatgtaaaataactaaggatgggaggggagcaaatgtagaaaatggtaaaccatttcgaaggtaatgagggttgtccggggaaagagatgatgacaccctggactaggtttgggtgctggagtcaacttatgtaaattatttaggagggagagccaacaggatttgcatatcatggggatttctgcatgtattattttagaggtgaaatcaatgggacttgaaagagaagcttatatgtgatatatctgacttgagcaaccagatgaaccatgctgctagtcaataaaattggcaggattaaataaatctcttatatgaggtagaagaccacatcttgaatacattgagtttgagatgcctttggaccatccaagatgaaatgtcggataagcagcaggagcgatgccttggtcccacagacaagagagtgagaagcagttatacgtgggtcatggtataaatcatatgatggccagtgaagccatgagtgtgggaggtcatattcagtgaaagctcagagtgagaagagtgcctttacacaagtttttattaaggacttcctgtgatagcattgactgctgatcacattggtgtttgcataaaatagcataatctaatccacaaattctctttcttagaagttgtttagaagtaaaagcaaagctgctcttcaataaatgtctcttgcacatactcagcaatcctagaagagaagccaaaagatacaatcagtatgtaaaggtacgatcagtgtgtaaagatacagtcagtgtgtaaagataggtcagtgcttagaatgatcgaggggaagtcccagatgaaaaatgttgaaggttgtctggccatgtcagtttcaaacccaaatgaatcctgagatttttatgccctatagaaatagttactcattaagattttatcaaaatagtctccttgaaaaaataattctcatgtttgtcagctgcagtgtgtaatctaaaatttaattagagattttaaatatctcttgaatctctgatagcagttttcaagacatttgaggcttattagctcagcccattttactgcagggaagaatgagatagcaatggtgaactttttttttttttttaatgttaggcaactccttttattccataatgagaaaacacctgctttttaattaaaattctatttctgtatacctttgtttgagtagttgaatcctaaatattcaggggcagtgagtccatttaaaactcataacaagtaaaacttcttaaatttaattgtacccttcaggttcaaaagtgctttggtaatttgggttctaaacagaatgtgggaagcaattaagggaggctgctattgtgaatcatgcatcacactcagaatcgaaagacgtgggttttcattcaccctgtgctacacacaggatatgtttatgagctgagctctgtggaagcagagacatttcttaacctcccaatctccacatctaccttataaagatttggtaggttttgttgtttctgttgttgttgaagttttaaagtttatggtgaaatatatgtcagacattcaggtaagaataaaatattataaaaagtattataataaacattaggtttctttaagctaacattaggaagtaattacttcagtttattttttaaggaattaaatgctataaacacaattgagatcctttttctacctttctcccatatcatttccttccctcctcctccactatacatacaattaggaattcagtgcacataaaaatatttttttttagactgaaggactcctagatccttatctatgactatagagaaacagatcagagagtgtgctaaatctataggtgctggccctgtatatgtcaaaaggataataatttctataaatgtattctgtacttttgttacataattatgtattgataagtatatgtaattttttgcactatgtgttaacgtttatcgaaatagcactacgtgtacattacactacatgtaacattgaacctcttgcttttttactcaatatttttttgagttttctctatgttggtaaaggttactaattcattccaagttctacatcatattattccatttacaaatgtagcataatatagtcttccatattcctgctgatggatgttagattgtttataatgttaaattgttcattataaataatgaagtaatgagcattactgctcttgaacatgccttgtgttcatatgtgagagttttatacacaggatatttctttcttgctgtagactaaaattgttcacttttactatcacactgctatattgttttccaaagtggttgtacaaatttacacttccaatagcagtgtatgagagtcttatttttccatatttctgcaaatatctagtttttccttttttgtatgtgtgcctgaatttatctcagactttcatagctaaatttttggggccacctctactgtcactactaacatctccatgaatgccaccatctccctgattctttccatgcgagcattgtatataggtgcaatggaatgggccaagtgctatttgtaatcatggcagctgtcgtctaatatataactctatataatcaaaataacatgagtaaaatctttaatctgtcttattcattcattatatgttagttaaatgttggcactaagaataattataattctgatttaataattaaaaagataaaagaattatataattttttatgagaacacaccagattcaccatgaacttcaaagagggatacataaaattctgcccttgtgtggatcaaatacatgacatctaacctcaccggaaaactggaaaattagtcaaaatagcaaataattatgtagcttcttccatcccctctttgacattccctaatttcacataattctagaattaaaaggaatacagtaacaaccttgcctaagtttcttatttaaaattcaggaagaatattctcaaattatgaatcctaaagaggtgaaatgccttgataaagtcacataacaacagattttcacctttaacttctttttcctgatttttggcagcctgagaccctgcagtgcagtgttctgccaaaacacgtgggcctgttgccctcaagaacagcccaagccatcaagatttccctgactcacttgtttactctaacatctcacctcctttttctgtaatatttcaggactttcctccttgctaaccaatctaataagctaatgagccagcactggcagaggtttaatgttctatccattctcaataatattgcccaagagggaaatttttcagccagtttctgttgaagcctctcaaaatattactctacaactatcaacctaatcttctcaaatgtaggcagaaaaacaaaaatcacttcagtcttttctattttaatttactgaggtacactaaagaaaacttctctatcattatccacctcataaaggcctgagacaatcacactcatcacttaaattcagacataagcatggcacgctaatgaaactaaggcaaatatgaaggtaacagtttatttttaatgcctattaaatattgttaaattaaaatgaaacatttaagaaaatatatgtgacattcaaatgaacaccaaatgattcatttcacactagtcaatattaaattaactccatattacatgaaaatgttaaatactactgaaataagcagcaaaagaaaattatactgtaacctcacaaacacatcatggttggaaatttgttattcaaaaaagattaagactaattttgtaaaactgttttaaagtcaattatttttaaaaagaattacgagaaaatatcatcacatcagtggttccattatatgttttaaattaatgaactaatgaaacccactaaaatgtaggcaggtgtaaacaaattgctgtttgtataacgcaatacttagtaaagattatttaagtagtatgctaaaatctaaacaatacgtagagtctataaaggataacttttagaattacgtttcaaaattaaagttgaaataataaactgaagaaattgctaacctaatcaattctgagtttgcaatatacaacacgggattggtcacctgatatcaatatgtaagttgtttcaaagtgcaaacttgattttaaaaagtttctttggtcttcatattaaagacatatttaagtatcacagataaattactcaagttatcagttaaattgctcaaagagtaacaccataattactatacaataatattttgattattttgacctctataatcatgctgaagagatatttataggttcttgattaatgggcaattttttgatttagattaattctatgataaacttaaggttatcaagtcttattttttcttcaataatttaacattcacacacagacacacacacttgagtccacgcttgagtgcccactctacaccgtgctgggactcagaaataagaaatcctcggccgggcgcggtggctcacgcctgtaatcccagcactttggggcgctgaggcgggtggatcgtgaggtcaggagatcgagaccatcctggctaacgcggtgaaaccccgtctctactaaaaacacaaaacattagccggacgtggtggcgggcacctgtaatccaagctactcaggaggctgaggcaggaggatggcgtgaacccgggaggcggagcttgcagtgagctgcactccagcctgggcgacagagccagactccgtctcaaaaaacaaaaaaaaagaaaaaaagaaaatccttaaaaaaatcagagattaacggggatgacagacaaactaggacacagtgttgcctgctatgcatgggaacgttagcagaacactctgggaggcccagaggaacagtgtatattggatttggggtggcatcactttctcaggggagtgttgtgtggattgagtcttcagggactagtacttgccagctagacaaattggtgcatactggggctggagaagcagcccatgggaccacaggaaaagcagcagcagctggtgcactgcactctggaaactatactacccaaggtcagtcatgagatgagcttgatgaagtgagagagaagtgtctagaggaagggtcagtactaaatcgcaaaggcctcacatcatgatgagtgactgcagcttgatgaacagatagagaagtctgcaaaaaaaggtcaacagagaaatggcgttatcagattgattttccagaaagctcctactagttgcctcattgttgttgaatatttcctacaattggaaacattaagggcacataaggagaggctttgtgatgatggcccaaggctttacctgggattgaccatagaaggaagggtcagaggctatgctatatttatggctaacagccttgtatatctttttttttagatggagtcttgctcttatagccaaggctggaatgcagtggtgccatcttggctcactgcaacctctgcctccggggttcaagcgattctcctgcctcagccttccaagtagctgggattacaggcacccatcaccaagcctggctaatttctgtgttcttagtagagacagggtttcactatattggccaggctgatcgtgaactcctgaccttaagtgatcagcccaccttgaactcccaaagtcctgggattacaggcatgatccaccgtgcctggccaccctgtatatcttaaactagaacaataaagtgaaggatgtaacttttttttgtttggttatttcttccttgtaagcttggacacaaactaaaatggctcatgagtacagctggaagttaactcaagttagaggtctgcaaattatggcccctggactacacctagtccactatcttattctgtaaatagagttttgtcggaaacaacccagtcacattaaaaccaaagcttattcttctatgaattgtctgtggctgattttgtacaacagcagaaaatcacaaaagagaccataaggcatgcaaagaagaaaatacagtctagccccatatagataaagcttgccaacccttcatttaagagatcactcagtgcagatcgtgtattttttcccacatatttccatcttttttgctctttattgtttcttacaccttagatgcacctggaatcattttctctctgtctacagttcatctcttagaatgactttagtgaaagttgtcacaaagacccctctcaacattgttgctctgaaaaagtccgtttttatcagcattcctgaaatgttctctagattataatcattctcttttagtgcattaaagagattattccactattgactgtctgactttgttgctgttgagaagttagccatcagtcaaattcttgctcctttgagggtgatattttgttgctgttcttcacctgtggcctttcttaagatttttttctcagtctttttttcccccagcagtttcaatgtaacatatttagttgcagatttctttttaattatcttgcatgggatttgtgagcttcttgaatctgcagattactgtctttcagatctagaaaattgtcaatcacaatcttttcagatatatcagctgtcctccagtctctcctctccatctgggactcggattacatttcctaaatcttgtgttggtgtcattcatggttagtaatctctctcatgtatagtccatcatgggtcttttaaaattaaactcaagataattgtttgcaagctatcttctcagatacaaagtctgtctttagctgtcttcagtttgttgttaagtctgctcacagagatcttaatttctatgatatatttttccagaagattttttaaaccttctatgtctgtttctatggttccctgtcctctgcagatatcttttagttggtccttcatttatttacacctttcagtgtagttgttttataatcagtatctaattacttattaataaatatctgatgtctttaccttttgctgtggttccgttttccatttctgtccttttctacttgttctcatagtctagcaccttgttgtcatttttgacatgatgaatattctttttgaaaaaaaaaatttagaactaattgacaaacatttttcaaagagaatgttcattgctgcatcaagttcaagacgtggtacagaaaatacatgactaattctaccgaggttctaccacttccattcaccctttgcctgagggcaaactctttagggtctcagtttatcaagaaggagtcttattagacttccaattttaggtgaattctgcattagattttgattccattcccagaaggcctctgctaggaaatcaaataccttcagggaaaaatccgcttttgtaccaagataaatttccaagttttcattattccttcttttcaggcctcaaaatgtcttattgtcttgttgtctgtgtgatgcttttaagaaattattttgtaatatttttatcagcttttttagttgttttcaacaggccagaatgtccctgtaagcagaccctcccattactataaacagtaagccttctgaacaggcattttaacagtaagagtattaggttaagtaaggtcttaaataaaaaccttcctgctaaggtctttgcttcctctgctgcctttgtgagccaaggggaggtttctcactctttaaaactcctgtgggcttaaaggaaggtagccaggcttcgtgctcttttagctccaaactggtacaaagtctgtgttaaaatagccagtcgaggccatttttgtctacatggaactatggttatggcatgtaaccagaatgctaaaaactctttgctggtaacattgtagactgcaaaaatggcaacttggcagctttttgaaaaatgatgtggagtcgatttcttcaccctttcattctggactgctttgcatattacttggttaatacaatgctacagaaaggatgttggatataatctgagtagtctcaagaattttgaggtatatccactcttacttttggaactctgtgaacttcacatctaataaattactggacgatttgagtccatatggaaaggtgccctactcattccagccagtgaacctaccagctaactacagatgcatgagcaatctctctttagatcaactgagaggaaccagtgtggcccagactagaaccactcagtgaaattcacaccagattgccaacctaggaattcgtgagctaaataactggttattgttttaagctactaaatgtagaagaggttaggtttgcagaaaaactcaacacctagagctatattactttatttaaattgttcttcttaaaattaaatctctctcagttatcaaatcaatgagcatttttcagtccttatctaatgagactattttacagtatctgacagtattgattattcgtaaacaatctatactcttttagtgtctatgacactggatctttgtgcttctgctggaatttctgtactattcattcttcatttcccttgtagattttatttcttcttgttttccttataagtatcagcatttgttaggtttccgtctttttcttatgtttccatccacaaactctccctgttggatctcctccacttttttttctatttcaatgaccactttgtataaagatataaattatgtctttatgcaaagcctcttcctgcattaaagtcctgaatatataatctgacagttaggtaatagtcagatatatgtcccgaggccctatgcttcaacatatcccaaagtatgtaactgcgttcttctctgccatctgctggctggctattcctctatttcacatagtatcacaactagtcacccagcaacctactagagaaacctggcataacacatgcctccctcctcattatatttgtgtccactctgtttctctcgcactgctctagtttaggccttccttctctctcttttgaaacattatgatcgtttcttgactagtatccttagctgtagtttgtttctcttatatctattctaaacttagctgtcaaaaaagttattaaacaacaactttcagagcatttgctacagtgaatttggcaaataataaacatatttgctaccacaatttttgtctctgcctctgaaagttatcactaagtgatttctgcaagattttcatggtagcatccaactacacagccagccattgctattggataggagatagctttaaacctgaaatctgtttgccttaggattgtcaaagattaacaaagcgggacagtagttaacatggcagggatatattttaatcagtaatatactactgcaataaggaagaggatctagttctatcacaaacacctcttctaacatccaggttagttttctttcaggtgtctttgtatgaaacatctagagtgggttaggggctatacctttgtgatcctgtcaaacctatatgacatcctatcaatatgaatacgaaacctatatgaatccctattaatatacctgctcacaattttgaggttttctgatgatatttctatttatttcacttggactctgtgaagtcaagtactgtatcttaaatatttttatatccccatcatttagcacagtacgtgacaattaaaatcagtcagtgattttaaaatttaacaacaacaaaaacacataataatgcgctgacctcctacaactctaatagtgcttgtgggctcaacattatctgaaaattgttcatttagccagaattatgatttcaaaataactaaggactataggcaactcattctattgcctcagggaaacgtccaaggtgtcctacttttgtggacatgtgtcatctgacaaaaggttgtcaagttcactgttctttccagttctgcctggtactatgattgcagtgcctaagcagcttgaatttcctgggcaagtgtgcaccatgctgtaataattcagaagctgtttttgtgttcttgaaacatatggtgctagctcagatttatcttgggaaaagctggtcaggaagagaaactgctgaagagctgaaatctctcccagcagctaagaaaacaacggagggacactggcgtccttcctccgagagctcaggctctccgccagtttgtggtccatatgctgaatccagagagctgcttcacttctaataacgattgtgttaagttgtgtgaggctgatattcctccagagggctcacagtttcaagcatacctaaaagcacctgttaggaagcagagcctcagaaaaatgcattagcatttctaggaaaagggcttatttttattcttcttggttacagagttgcaagttggcttgttcagaaagagctgtttttgcaccacactgatgttcagtttggtgcaacatttaagtctgggaagagcacagagccaaatgtggcaagagatggcaatagagaaaatgccaagtgccccctggcttatctcttgtagaagaatttgtagcaaggcttagaccacctgaaatgaatagcattctgcagttctgtctgaatttcactctgtgatttattatttcattatactagactgaatttgaaccaacaaatagttcacccagggaataaaatatacctttactttacagatcctttcccttcccttcccatatctttttcttctttctgtcccacctccaccaatgtgtgtatgtgtatgtgtgagcacgtgtgtgtgtgtgtactcacatccattctaattactggaaacctacctttgctggagcaggttaaatattgcctcttaaatattagtatgtttagaaagcccattcctataataaaagtggtcatttctacccagttgttcccaaatttcaataaattaatctgaataaatgagtttatagatattacacttagaaaatgcatagttaaaaggaaacattttaataaaataacacttttgaaaaagccaaatttcaaactggaaaatcagaagcaggtagtggccagtgccactagaacatgttaggaaatctcaaagtttcccctccccctttaaaaaacagtgttcctcagaaaaagtatacatatctcatttaactcagcctttttagcccagtcctattatagtgctgtttgttccaaactgttttataaaatatgtttatgctaaaatatgtaatattaccttccactaaataaataaatatattgtacacacatcacatacatatgtgccatcaccaactcctatatgaggactaaagctctgattttttatcttggccaaattcctacctaaggggtgtcgggagtcatgccctgcaaaccacaaattctcatcaggtgggtaccctatatatcgtgacttactttccaatctgactctggcataacattatgagacaaggaagaaaatcaaaatatttcaccccaaaacatgtttttctgccatgtcttggaatggccctacaaagccatcctttgttgggaaagatctgcatctgtaaagaatctctgttaacatagctagatctttttctttcaggccctcccaattctgaagagattaactaaaagtctagcaccttttaaagatctgaataggaaacatttgtcatctattgtctctaactgcagccactataagatttcaaaagaactttggtctctacgatcttttatcttaacccgaatatttcttttctatccatctcaggtctttagacaaactcaacccattgtcaaccagaaaatgtttaaatttacccatagcctggaagccaccccccaacccctccctgcttagagagttgtcctgcctttctgaaccaaatcaatgtatttcttttttttttttttttttttgtgacggagtctcccaggctgtcacccaggctggagtgtagtggcgccatctcggctcactgcaagctccgccttccgggttcacaccattctcctgcctcagcctccccagtagctgggactacaggcgcccaccactatgcctggctaattttttgtatttttagtagagacagggtttcaccgtgttatccaggaaggtctcgatctcctgacctcatgacctgctcgcctcggcctcccaaagtgctgggattagggcgtgagccaccgtgcccagccaaatcaatgtatttcttaaatgtatttaattgatgtctcctgcctccctaaaatatataaaaccaagttgtaccccaataaccttgggcacatgtcaggacctcctgagagctgtgtcatgggccgtggtcactcatatttgtctcagaataaatctcttcaaatattttacagggcttgactattttcgtcaacatatactataatatcttccaaaatgtggtcttaactcacgagagcaaacagtgcagagtgtgtgatattttctaattccatgagtattagctggttgcaaaacaagcattctcagcccatggcactgtgtattccaagtcgagcgtattctttaatgtgtttttattttgcttcactctctcatgttaccatttatctcatcttatggtaaagcagttttgatccataatggtatttttaaaagctaaattttccaaactgaaacacctagctgagtaggccgcgagttaaaagagtagtgtggcaatggctgtagattccttcaaggaagtggttgaaggaagggatggattttagggattggttgaagtcctttaatattttcttcagcataaaaaactgactaaatcaattagtacaaatactttccagagcagtggtccttaaactctagcatgcatcagaatcacatggcaggtgactgaaaccacagattgctggccccacctttagggtttctatttaggaagtcaaggtcgtgacctgagactatgtctttctttttctttctttcttttcttttcttttcttttttttttttttttttgacagagtttcactcttgttgcccaggctagagttgcacaggctggagtgcaattggcccaatctcggctcaccgcaacctctgcctcccgggttcaagcgattctcctgcctcagcctctcgagtagctgggattacaggcatgcatcaccacgcccagctaattttgtatttttagtagagatgggggtttctccatgttggtcagtctggtctcaaactcatgacctcaggtcatctgcccacctcggcctcccaaagtgctgggattacaggcatgagtcaccgcacccagccaactctgcctttctaacaagttctcaagttatgcagatgctgtcaggtggtgtcttggttgatttgagccgctgtaacaaaataccatagacttggtggcttataaacacagacctttatttttcacagttctagaggctgggaagcctgggaagtttaagatgaaggctccagaaaattcagtgtctggggagagccctcttcttggtttatagatggtgctttttagctgtgtcctcacacggtggaaggagagacctagctttctccagcctcttttataagggcactaatcccattcatgagggctccactctcatgacctaatcacctcctaaaggccttgcctcctaacaccatcaccttgggtgttagaatttccatatataaattgttaagggacacaaacattcagaccatagcagcaggagggaacacactttgatagctgttcttctagagaaatgtctatagtgcttttcagtctggatttcataagggttactatggtattatctgagaaaaacaaaaatggtgctacctagctaacttccacagaaaaaaatcaaaaacaacttttctttttttcttttattttctcctttttctttgagagacggggtcttgctgggtcacccaggctagaatgcagtggcctgatcatggctcacagcagccttgacctcctgggatcaagggatcctcccacctcagcctcagctgggaatacacatgggcatcaccatgcctgattgatttttttaaaattatctgtagagacaggatctcactgtgttgcccaggctggtctcaaattcctggcctcaagcaaccctcctaccttggcctcccaaagtgccgggattaggattacagctgtgagccactgtgcctgacaaaaaaaaaaaaaaaaaaaccaaaaaacaaaaaaaaccttaaaactaaacaattttttaaaaaatataatgaatttatattaattttatgtttcttttccactgagaaattaggaaaatgtttagtgaacttttagccacatttaactaggaaaaaaacttcttaattttggcctgaattcctggctacagctgactgaccatcccttgacttccacaacctttattgccatcccaggttggcccctcatcctcagagtaacatcctggagagctgtcatcatccaagcttgcctcatatcttctgtcctaaatttttatgcgccaccttctgcccgcaaacttcttgacatcttcagcctgatttcctcttttccttttttttcctcttttatccatttctcagttcattctcttctgctttcattgtttttctgaacatacctagacctcatggtcaatcatcgcattgatcatttctttctaatattagaaatgtcctgactttcttgccattattcttacacacagtcagaataatccaatctaatcattcttttctctttgacttccacataacaatcattgctaggaaaattaatggttagactgccattggaatttccaactgcaaaatgtcctgtctccaagactagatgagcagtaattggacatatccctaatgagcactctgccgttttccacaatgtttatttcggattgtcatcactgaagtccctttctcactaccctctctatcacactttggaaaaagatctttcctcccatactgtacaaataaaataataataatagccaccaatcattttttcccttcaactttcttcacccttccctatcctgctacttgcggattcactcatctgtgcctcattgtttcctgcttcagaagaacacaagagcagaatcaagagccagcacaaacatagttttggaaaagtgcccgattttactttccatattttatcaccagtgtagtgtatgaaaaagtagggaacatttaaaagttcagaaacaagggctgatccattgcagtctgcactttcatgttccatgaaaaccaaaaaatcaaaaaactcactctattgaaatcatctctttcctggtttatctcttaaactaggaaatagttggttcctaggaaatagttggttaaactaggaatagtttggttccctgtgactcttgcctttcatatctatgtctacagcaactcagtatctagtacatcacagggactgcccagtaaatgattcagtgggtcattccttttttttttttcatgtctaatttttgttgatcctcactttgtgatccacaattattcccttttatttttctcttcttgagtgtcacatttgtgttatgttttatttgcttatctattttgacaaatgttcacatctttttaaaatatacatatgtatgagacataaaagtgcaaagaagaattctactcaaccagaagtaacccttgctagtgtgcatttatcatacgacattctggacaaggctctgtgcatatttaaaatgtgtagtccctgggtattcttctggtttctttctgttattacctctcttaatggggtgggaaggagtagataaaattctacctagagtagctatttgaagatgatgcttcaaatattatccccaagtggtgagggttttgtcagggatttggggaggggggtgaggggacttgcacttgcctcgggacagtctaaaattccaatttaggtttgtcatctcaaatacactctcacaagtctgctacgttctccaacttaggggcattgctctgtttagagtttggtttttgtaaaagttaaagaaagaggaaagaaacacaaaaagtggcttaacagtcaaagacaggtttattttggagaacaaacctgagaggggtttctggacgatttttttggtgaggagcactctctcttacggtctaagagtatttattggtgagagaggttggaaagtttctgtgttggggagaagtttatggtggggttggaatgtctctggttagagggcaggttatctggggtctgacatctctctggccggaggggagggttatctcagggctggcatgtctctggtcaggaaggggtttggaatgtttctggtcggagatgtcatttgtggtttatggtcatgctgaccttagccattaggctgataccgtttagatttaggtggtttttgatcaaggtgaactttaaaatggcagtgctcatccaagatggcaatgctcctgctctgtcagttttcagggtgggattgtgactcacaacaatgttctgtgatataaagagatggccattgctttcccaccctcctcattctcttatatccaaccatctccctgtgctaagaagccagatcaaggcaacaccaatggccctccagcaaggttccactgtacgacttcctctcctgttctaccttgtggatttgcatctaaaccttgtctggctcccttcatccctcagaccactttcacacttctaaacttcatccacattttccacagagtcatcacattgtcttttcagattcattcactcacttttagataagtctgtacttgtctgaagtctgaggacataaatatcagctttaatcatcctccatgattttgatccaaatttgagtatgtgatggagatcatttgagttttaggtttgaagttagtttttttgtttttttgttttccaccacataggaaaagttacactctcctcgccttctcccccctcaaccccaacatgtgtctatatgtttagtgacacttaagggaaaaaagtagaagaaaaatggcctagtgctgctatttttcattggccgtccgtcctaccaatttactttgaaatttgtttgaagaatgatgtactgaagaggaaagatgaacaacagcaaaaagtcccttgttagttatgctttgctcacggaagaccctcattttggtgtcctatgacctgcagttcagttccgtttctctcctctgagtgtccatgtttagcccacctgcctctgcattgggctttatagcctatttgttgttgagtagtgaggattacatcttgttagaaatgtaagctgaaaatagtcacagtggagctctagaatcaactttcttggcaaaagtgctaaatagtcatcttgactctggtaagccagggatactattactactaataaccattgcggcctactgagtgcacacaccgtgccaggtagtctgctaagggcttcagtgcattttaatcttttcaccagcccaggactctgttgttttttgtttttttcttaagtaaagaatttttaaaataaagaaactgaacctcagaaagcttagataatttgtgctagttcatcacactaataagtggtagactctctctgtttgactccaatgactatattcttgaacactatccaaatgaataccaaataactcactttgcaaacatttcatgtccattatcacctcattaatttgttcattttattgctcatttccagaatgctcttgccactccttttatcataaaacatcccatccattcttaaagagccagcttatatctaatcttgtatcttatccttcccctaattatccagcataaaatagtgtttctgcctctgttccccataagcgtgtctgttttaacacttatttttaatatatcagttaatgttagacatctatcacctttcggtctcagagttgtaccagttcccatctcctactgtatctggtaaaggacagctttttgttttgattttcagaacttgatttcaatatatatatatgaaaagaggggacaagataaaataaaaaaagtaacatttgatataataatgtctaagtcaaattctaggatttactaggtgtgttatattagaaaatgcaacagggatcactaaacctcaatattgtcttctgaagaaattatcttcataataaaactacttgttttacctttgattgagtttttaagagaaaagcaaatacaataataagtgatgaagtattataactcataatgtgctatgttactgtattttgtcgttgctgataaaaatagttgattgatgactttttaagtgacttttaggcagtctagagtgagcagtaaaagaaattaaagctgaaacagtgaacctaaaattctgttgtagaagttgttaataactgtcttttcttcagcagaagttacctagttctacattgcctctggctttttgccacccattaagataaaaagctagaagataggaactaggaaatagtagagataaggtgaaagtctagcttgaactcagtgaagcaaaccaaaataagcaaagatccctcacttggagatgtggtagaagacttgtgtgaattattacagtgactaactacacagaggaataaagttatacatataaagttaaaagatatgtaatatgagtgctcctgttgaatcagccaacatgaattcagtcatatagtcacaacagtgtgcatcataaaacagtatcataaatagcaatgagttataaatggaattgaccaatatacttagtgagaccaatatacttggtgagaaactacactgtgttattactttgtacaattataaaagataattgcccaatataaataataactaaaatttaagaagaaattttctatttttaatctagattataaaatgaatgatagttatgtaaagtttatctatttttctttggaaggaaaccaaatctggagacataataataatttggtatcatgtaatgcctaggaaatagtacatatctaataaatatttgttgagtgaataaatgaatgacagccactgtaataagttaaaaagtttttgtaggtaaaagacaaggctgaaacaatgattctgactcataagtggtgggccattaattatatacatatatgcagagacacacacataaactttaagaaaataaaattttaggaaaatagataaaatgtcaactagtattttattgttctgctaaatgaatttgttgtcattcatgacagtgtaatgattccatcttgtgtctttgtgtaggcacatgtgtgaaccactttaatccccctctttttaattttctaacattaaaaaaactatttttttgtgtccatgagacatacagtttcaaaattattttatgaaattgaatggatagtataggaattaatgtcatgtatatcacagtgtgattccttttaaaactgaatgagaggaagttaaggcatgcctactggttttcaggggcatctagtaactttgagttattaagtaatgaaatgtgagtgacggagttcaagttcctattaaacataaggagaaaaacattcatatagtaggtttaatcactgttactttacactttgatgtgcaaattaaaatcgagaacgtgtcatttaagtaggcttaagagttattcagaggtagaaatatgacagcagctgacctttattgttatattttactgcaacaaaagctctgtggatgttacgcagtttctagtgtgaattgtctgaaggtgataaaagaattcaaatatctggactgaggtatatattttaggagatagaaaaatcactttcttaccttcggcaaactttctcattgatcacaagagtcaaagggcaatcttcaatcctctaacttacatcacatggtaaactacttcctttgcaatccataaaatgaaaggtacaggtgatattctgcaaatacaataagaagattctgttgggttacgagcgtcttgtctgattaatttttacattccctggacctaaaataatacctgttttgaaacagtagctccatgagtatttaccgaggtcagcagaatttcattaactgaatttaaatgtagtaattgaattacccacacaagtaatttagtttgagtagttttacttagctaatagtggcaagcataacattaaaatgggcaaagaaataagcataccagagttctgcaagcattttctataaacagccagataataagtattttaacttacgagggtttaaaaataaaattaaggatattatgtaggtgcatacataacaatttaaaatgtaacaatttaaaaacaaaacaaaactatttgtaactcacaagccatacaaaaacagacaactggcactttggctagtgggctacagtttgcccttccctgaaacagatttttgtgcaataaattcaaagattttgttcccgtagttgacctaaataattctgtagatttggtcctccatgatgcaaatttacatagacaaggtgattagacagatgatggattgaaatcaatttcttgtgagttaaattaaacaattgaaatgaattgttttattatgcctttgtctctgcatataagttagcaaattctgggagccaagtggaaaatgtggataaaaggatttaagcatgtctggagcccctagggagaatggcatctttggaagaaaaaagttagtggagttcaaagtgtgccttagaaaaggatagatttagatagaagatctcatccctggtaacaggaggaaggtcatatgcagatgggctttgggaggagtgtgagggtgagttagttggagcaggtgagggcagtggagctcactctactaacctggcagaacactgtggtcctcaaggcctgatgtaagtgcatttagctctgggagacattagacacaagtaagatctattcaggaaaatgttattacttgttcccaaaaggaattctgcaattctgtttggttttttttttgttttttttttttgatacggagtctcactctgtctcccaggctggaatgcagtggcactatcttggctcactgcaacctctaccacttgggttcaaacagaaattctgcacttctaactgaacaaaatatgcaattaaatacacatgagcaatggaaataaattaactttagtcaattcatttctgtagttaaataacagtagtttatggaaaattagtattgccttatcaaaggagccaaaagccattttcaagactgtaaaacattttatatgtagtagtattaagtggtgtaatagtaaaatttaaaagaaaaacaaacaaacaaaaagaagatgagcaagcctcttgatctttctgaattttagcttcttcatgggtagggtgaagatgtgttacttaatgtttgccaatgtcttatctatctttacaatgccaagaagtcataaaatttttatgttaaatatctaaagtataaaattactctccaaactacccaaggtacacatgtatgtactcatgcaacacttagacccatagttcccaaactatgtgtcaaagtgccttagggagctttaggcttgtgggtcatacaatttcttacaaaataactcaactctgtagccctaaagcagacgtaaataatatgcaaacacatgagcatagctgtgttttgacaaagctttattttcaaaaagaagtggccaacacccaagctgtacttcactgaactctggtatacagtatatacatatatatttatatatgcacattaaatatatgcgttgatatgcgttcaagcaatgtacaaatatatgaagtttcctaattgatgaataaaatgataaacacataaatacttaagtgaagaatggagagaaggaagacagtaggtagattagagatagcctgagtcaaaaggaataaaagccactagtcagggaaaagagcttaatacattcatatacatatacacatacatatacacacagatgctcctcaattttacaatagggttttatcccaataaacccctcataatttgaacatatgatgggcttatcaggagagaaccccatcataaatcaagaagtatactaaatgcatacacttttgtaccattttaaagttggcaaatatatgttgaaccttcctaagttggaaaatggtctatctatacatgtatgtacttgtatatttgttctctgttcctctatgaaatattgatgacaaatttgttatttatttgtcgtaacagttcgtctcagatgtgatagatacacagtgtgtatgattatgaaacttgtaaaaagttttaagaataaataaatcaataaacatccatttcaatcctgatagtaatgaagtttaaactcatttccttggtactgtctcttaaaaatagtaataaaaggttttgcttgagcagaatgactgcctaatgtagacattacactcttgtgaaaataaccactttgataatacaaagatagccagtctggtagagattaaactgagacagctaagcacctgtgttgcagacattcagttggccatgttatcaagacccaagatattgtaacaaataaataaagtcatagtagtaataataataaagctaatcaggccaacagaatgccccccaaatttatttccacttaataaatgctcttctaacctcatattaaaaattgtgtctctgattccagttaaagaccaaattttaaaaatacagagactccaaatctgattctgtattgaattctaatgtgaagatctttgctggaatgcttcaaaggagattagaaatattgattatcatttaagtactcttagatcaccaaaatctcactaatgaagaatttctttatatcatgactgtgattggctagttaacaaactataaaatgaacatgtaatacattaatccctcaataacatgacctggaatccctacattctaaaaatatctctttgttttctgcctgtatttgacagaaatacggcattaatgaaatgttcagttcttgcttaaagtacataccggcataatttttcaaggaatgtagggcttcaacacttcttaaaagtcaagtttgactcttcctaggatagaatatagaggtatgattaggtaaccttaagtgagagagagattgcacgtagaaaataaagcttattctgccacctagaacagttttttgaatagtccttgttatgtctgaatcttgtcactcaggtctcagttgaaatactagctttctacagagatcactttttgatcactgttttaggaaggggtctttagaaattagattttgggacagaaatgggtatgtaggaagcttactggaaattgccttggaattaacacctgtagtggggtgaaggaacctggactggcagagaaatgtagtcaaaattaaggccacagcagattcatctttttcaccaggagctctggtgctggaatgcatctgtagaattattccaactttccccagaggagtaggcattcatgtccccatatcagtcagccattggatgagggatgggtgcacacgcatggttgtcttacctctccttggctgaggacaattcccagagcaaggctctgactgagagctttcagccaaaaacactcccagaagttgggggagtaacagcttcagtcctaatgagagaaatagatggtttaaaatggcatctgcaacattctactccctgcactattcagatacttgtgattcatatacagtcatgcatcccttaccaacagggatacattctgagaaatgggtccttatatgatttcatcattgtacgaacatcatagagcatacttacggaaacctagactgtatagcctactacacacctagggtatatggtatagtctactgctcctgggctacaaacctgtacgacatgttattgtattgaatattgtagtcaattgtcacacaatggtatttgtgaatctaaacattaaaaaaaaggtacagtaaaaattcagtactataatcttacggcaccaccattgtataggcggcccatcatttatcaaaacgtcattatgcggtgcatgagtgtattaagttctggaatcagctcctctagaatccctggaaaaacacaaaaaggacagtaaatgagacaaactacagcccatgcactatagctagtcagaagtcataaatgatattcattgtttctctcttccattatgatttctagattcacctttaactagtgcttctgaagatctgggtagctactaaatgcagaatgtcatatctgcagggtctgggttcttagtcatcataaacttctcaggccttacctgtttctcttgtccagttaccacaaaaatttagcaacagagaacaaagagatgcctcaagaatcaccaggtttaggccaggcacagtggctcatgcctgtaatcctagcactttgggaggccaaggcgggcggatcacttgaggtcaggagttcaaaaccagcctggccaagatggcaaaaccccatctctgctaaaaatacaaaaaaaaaaaaaaaagaaaaaaagaaaagaaaaatagctggacgtggtggtgggtgcctgtaatcccagctactcaggaggctgaggcaggagaatcacttgaacccaggaggcggaggttgctgcgagccaaggttgtgccactgcactccagcatgggcgacagaacaagactccatctaaacaacaacaaagaatcaccaggtttattatatgggggccatgcaaattcttccttgtccccattgtgaaacagcagccatactttctcccggtgatcaaggtagcatctccaggatgactatcactttatttgtctcctggagaactggtatgagaaggtccaagtgacaaggtagcagctatagcttaaatgttaatggggcttttgtggcccctcaaggtcaaggacctttaaacctctagaaccaagaactgtaaggacagaaagcatagattcctaggagttcaaggcagtgagctatgagtcactggaagtaatgatacacagagccattacttagctcacatattcatgtattatactgttgaggatgtactcatacacaatggtccctcatgtagagtgcatgctgtctcctggaggatgggtcccctcagtgtgttatttccaagatggtgtctctgttgtgcctttacaaggatcttcttttgctctgtaaggctggcagcttctgagtgttgtagggtgtgacagagccagtggatcccatggatatctgccacatctcctttgctgcagtgtgaattacttggttcaataagatctaacatatgacataaatgttgatgtagtaagcagtctttagtccattgtacaatggttctgacagagaccctgtgagtagaaaaggcaaatctattcttggttatatggatgatgccactcaagatgaatttctgctctttccagagtgaaaaatatttaatacaatgaacgtgccaccaagtggctggttggtcttctgaaaagatgatgtcatatgggaggtagagaacttgtctctgttggctgcatgcagtggttcacacctgtaatccaagcactttgggaggccaaggcaagaggatcacttgacatgagttcgaggccagcctgggcaacagggcaacaaagatcctgtctctataaacacccttaaagaaattggccatgcatggtggcacatgcctgtagtcctagctacttgggaggctgaggtgggaggattgcttgaacccaggagtttgaggctgcagtgagttataatcttgccacaggactttagccgctgagtgacagaatgtgaccacgtctaaattaaaaaacacacacacacacacacacatatgaaatatatataaaggaatatataagaattatatatatacacacatatatttgtatatacgtatgtgtgtatgtacatgtgtgtgtgtatgtgtgtgtgtgtgtatatatgtatcaattggtctctgttattggcagcttaggtatccaaagtggcggtaactaagatggcatatgaaatatgctgactgacatgaactggctaacttaacttggatgatcactgcctcttttaagttgctcttgggggagtattaacctgtgacacaaagatgttcacaaattatgatcattcccatagatccatccacatatctaatttccatatctcctttttctcagtcataatgtttatccttccaggcccctgaacaattagtcaattcaccacagtccatgagtctgtaaacatccttatcttgggccacttttctttccacaccaaatggaaaactgcatcacttgcagctctcaccactgggagaacttattcttacagttgttttttagggtcacttttagtttttacccacatgctgagccaactcccctgtgaaccaagctcagtcactttcctgctcggcccaccagtcatatttgtcctcatcacgcagccacaggtatgtgctgtgggagggattttgatgtaatagtgatggatgacatggagtctgggctacctgattacacatcatagttgtgccctctatttctgctcttgctcaatcccaggtgtgcaattccatcttttgatggatttcttctgcacctaccccaccttatggctggatgagactctcagaaattcatgatggaaatatctggttacaaaatcacttgatatctcgtggttggctgacacatatctcctaataactgcttttggtatatagtataattctccagtgaggtggcatgatcttggaccagaactctaggggtgtacattgtgattctcctgtcagagtttgccataaactctgcattctttcctaccactgatatatgtaataatatgttatcttttggatcatacggcccaagtagggaagccactttctcctacaccccctacgaagcatttttcctcactagttttcactgaaaacaggcagcctttgctgtcacacactaatgggtagaatgagtattctcaagtgtgaaacatgctgtctttagaatccaaagtagtgctgcactttgtcttttaatttgattggattgtttcaacatgccaaagataactggactcctaaaaacatcactgctgtggttggcccttaaatcttcatggggtttatttacactttctaggccacacatgtttttccaaggcctctaacgcacttgcaacgtcttgctactctagttcagttaatacgaggttatcaatacagtggaccaatttgcaaaatatttgggtacctgaaccaattctgcaaattagttacatggtccagatttcttctgactaattatgaataggagaaatgaggaagttaacatagagttacataaaaaagtaaacgtacagtgggaagtattagtctgctagggctgctataacaaaatattataaactgagtgacttacacaacagacatttattttctcacagttccggaggctggagagtccaagatcaagatattggttcctggtgagggcttccttcctggcttgcagacagctgccttctcactgtgtcctcacagggcagagagagtgatagagagctctggtccctctttctcttctttcactcacaggggctccaaccctcatgaccatatataaacctaattacctctcaaaggcctcacctccaaataccatcatttttagggttagagtttcaaaatatgaatttgggggaacattaacattcagttaataacatgggggaggggttttttgtttgtttgtttgtttgtttgtttgtttttgagatagggtctcactctgtcgcccagtctggagtgcagtgatgtaaacttggctcactgcaacctccacctcccaagtttaagtgattctcctgcctcagcctcccaagtagctgggactacaggtgcctgccaccacgcccggctaatttttgtatttttagtagagacgaggtttcaccatattggccaggctggtcttgaacttgggactttgtgatccacccgcctcggcctcccaaggtgccgggattagaggcgtgagccaccacgcccggccatgggggagttttggtacagatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttgggttattctccttcagacaatgattctgattctctctttttttttttttttttttttgagacggagtctcactgtgtcgcccaggctggagtgcagtggcgcaatctcggctcactgcaagctccccctcccgggttcatgccattctcctgcctcagcctccaaagtagctgggactacaggcacctgccaccacgcccggctaatttttttgtacttttagtacaggcggggtttcaccatgttagccaggatggccgcgatctcctgacctcgggatccgcctgcctcagcctcccaaagtgctgggattacaggcgtgggcaaccacgcctggcctcagacaatgattcttgaaccaagtcttctttcagattttggctccaccatctccaaaacttggtttccagagttaacttggatatcacctcaatttctaattttaggaaatgagaaaggaatatagatgattatgcatgggaagtttttaatggagaaagcctaaaactaggttgtatggttactcttaactgcaaaagagaattcaaaatcgtttttccatgaagaatcagaaaggggaatgactttattccctctacctagaatagtgcctgactgatagcaaaaattcaatgtataaccatttaatatatgaataaattagtttgctttgctctgcttcccaaccaggaatgtactggttgataattacttatccaaaatgcttaggaccagaagtgttttggatttcatattttttcagatgctttaatatttgcatatactgtacctaatgagatatctttggaatagaacccaagtctgaaatttatttctgtttcatatacaccttaacacacagcctggaggtgattttatacaatatcttatacaatatttaaaataattttgtatgtgaaacaaagtttgtattaagtatttatacatggaattttccatttgtggtgtcatgttggtgctttaaaattttcagattttggagcatgtcaaatacatatgtcttttttttttttttttttttttttgtaagagacagggtcttgctctgttgcccaggctggagtactgtggcatgaccatagctcactgcagccttgacctcctgagctcaagcaatcctcctgcctaagcctcctgagtggctggatctacagaagctgccaccacacctggctatagacctaaacatatgtcttgcaaatgtttcacatgaccatagagtgagatattacttacatccatgaaaattctgagttctagagaaacaattcaaatggtgctgtttattattgattgattcataatttcatttatatataggcagtagcaatctgtctacagcctccttagtgataatatatgtgatcttccttgttccttcacactgagtaaggtttcatccctgttttttgtaagaggtagtctgtgttttttcctttgccaataactcagtgagagaccactgccctccaatataacatcaaaagtacctgatcaactaagtcaaaaatttacttgatcttctcttatgttatgtaggaaaaaaaatctgttttggccaggcgcggtggctcatgcctataatcccagtgctctgggaggccgaggcgggtggatcacgaggtcaagagattgagaccatcctggccaacatggtgaaaccccatctgtactaaaaatacaaaaattagccgggcgtggaggcacgcacctgtagtcccagctacttgggaggctgaggcaggagaattgcttgaacccaggagccagaggttgcagtgagccaagatggtgccactggactccagcctgggcgacagaacaagactccgtctcaaaaaaaaaaaaaatctgttttataaaatcaacgtttgcttgaattgattgaatttccccatggttacaaggaaataacctagtttgccaaagatgactcacagagtttatactttaccgtttgtctttagcacatactcatatctaggtctacctctctattgattattcttccttaaaatctttttctctgagatgattatgtcatgattttacacatccacatgtatattagtctgttttgcattgctataaaggaatacctgagactggtaatttataaaggaaagaggcttatttggctcatggttctgcaagctgtccaagaagcatggtgctagcatctgcttctggtgaaggcttcaaggagcttacactcataggaaaggaaaaaggggagcagatgtgtcacatggtgagagagagagagagagagagagagagagagagaggagaagcaggactgacttttttgagcaatcagatttgatggtaactaacagaccaagaattcattcattaccatggtgacagcaccaagtcattcatgaggagtctgccccgatgacccagacatctcccacttggccctatatccaacactggggatcacatttcaacatgaaatttggaggggacaaataccaaactatatcaatatgattctgcacatgaaatgggttagcatagttagagataattaactaggctccaagtctattaagttaatataaatcctaggcaaataaattatttatattttctaacaaaatatgtattgaagctaagcaggcacatctgatgaatcattcactcttttgtttgttgtttctttttaattacacaaattttcagtgattatattgaaaatcatgcaggcaaaagacttcgaataaacaaatgaaagttcttaaaagaaatgttacatcctaatggcaacacaaaccttctaatttttattttttaatgtaacttagaggctttaagtcacaggtcagattaacttctgatgtaacccagctatgcagactgtttcctactactgaagacatgaacatacatagaatttccatcacctaaaactgttttggcatcattgtgatggcctactgtacttttgcaaattactttatcatccttgctgctttgctattcttcttgtcaatgccatgtctctgataatgtcactttgaacagtgattgtgtgaatgctcagaattactaataatttccacagacagtatcttgtagtgaggtagtaacagaatatttttccattctgtgtcagtgtcttacaggactgattttttacaagatggctttcttggcatccaatgcaaggactctcaccccaagagaaaactttatgcacgaattagaaatgagggaataaagtttcttaaactaggactgcatcagaagatgtgttctctctgtctctgtttttttgtttgtttgttttttgtttattgagacaggggtcatgcttcgtcatccaaactgaagtgcagtggtgtgaacatggctgatttgcagcctcaatttcccaggctcaagcgatcctcctacctcagctccccgagtagctgggactacagcgcatgccaccacacccagctaattttacatttttttttcttgagacaagagttttgccttgttgcccaggtctgatctagtcctgagctcaagcaatccttccaccccagcttcccaaagttctgggattacaggcctgagccactgcacccagcctgatgtgtactctcttaaaacgttcttaaaccgggccgggcgcggtggctcacgcctgtgatcccagcactttgggaggccgaggcgggtggatcatgaggtcaggagatcgagaccatcctggccaacaaggtgaaaccccatctctactaaaaatacaaaaaattagccaggcgtggtggcaggtgcctgtagtcccagctactcgggagactgaggcaggagaatgacgtgaacccgggaggcggagcttgcagtgagctgagatcgagccactgcactccagcctgggcgacagagctaggctctgtctcaaaaaaaaaaaaaaaagttcttaaaccaacaattttctataatcactaattaatgatgatcatcataacttcaaccacggtatttttaaaagagatatttaagagacttttcccctgataatttttatattacttaatttgtgtattataacatgaagggaatagggatcaccgatttgacagtctattgttcagtctaattaagtatatacaaaactgaatttccttaaaatactgaaactcaaggattaaaaataaattgtttagtaagagaaaggagaaacaagaaagccgatgggaaagacaataaagaaggaacaataaaaagtttgtgggattggttatagcttttttttttttttttttttttttttttggtgctagccataagatttatcatatgtcagataactagaaaatcaaagcctatattttaaaatccaggagccaaaatttcgacagctgttttttaaacaatgactcagattagctagctagctaggtaggtaggtagataaatagaagatagatagataggtataggtataacaaaatctttttcaatttacatcacgagtatcttatgcattaccatcttattataaatgcaaaatgtactttaaaatgctaattttgagaaagataatgactaaggcaattttatagtacttgtgatttgttccgttagtatattactattacaatttcgaaagacttatagaacatttttagtcagtctttttaagaaaacctgaatgtgcaaaatttaaaacaagacattatcttttataaaagaatatattaatataatctcatctttgtttgaagggaaaagacatcaaataacctttatttttttccaaattcatgaatttatacatatttgatcagtataagtttttgagattacttcacataaaattaatcttttcagaattattgctgttaatttgatcacccagaataccagtgatttactcacccttttcatggtactggttttcactttcaccagcttacttttctgggtgatatatggaccctccatagatatttacccctagaaaagaatctacctattcctaatatgtatgtatctcaacttacatagatgaaatatgcagggaaaggagattgtggatttgtaaatctggagtagaatttaaaaaatcactgcacagatagaccaaagtttgcaaactcagatgccagcagaggtttggtaggtaatatacaagaattgaacagccatatataaaccaatatattggggtgaatttgaaagcctacgccccacgcaaaaagagagcacattatctacaaagctcaagcaaattatttccttgctgaatgtaaaatctatctttccaacatagaagaagtcagaaatccaattctttatgtcaactcagtctcagttaaatgcaggtaagcaatttgaattactgtattaaacaatgtacaaatcatacaaaacaaatctcttggagacatttggcctaccagtaagccaatttaaaacctgtgtggggatctagtgcaggaattacagattttctataaccaaagtctgaaaaaaaaatttaaattgaattttagcttcatccaacatagccactttttctaccattacctattatttcattcctgttagctttaatcatttacctgcttgcaggtcctgaatgaccttgagattgtaactaatgttggtccaaaaatctcactgacaatgttattgcggcatgatcagtgaaagagaagttgggttcatggttgagaaacagggatgagaaatataggagactggttgaatggaggtatggtggaactatgacaatgcccctgctgtatcagatgtggcccctgctgtatcagatgtggcacctcctcatccatttgagcagccatagctatgtagaaaaatcctgaatttatgtcattaaagatgtttgatgttaacataaactgatcatttataaagtaaataatagggatttggcgtgtgtgtgtctggccttgtcagaagtaaacaaggagaatattcataatcttactcaagtcatctggggaaggattgccccttgtagtaatacttttctggaaaacaaagaggtttggggatttcttaaccctaatgctttctagaatctcagggttcagttaaaactcaacattggcggccaggcatggtggctcacgcgtgtaatcccagcagtttgggaggccgaggtgggcagatcacgacgtcaggagatcgagaccatcctggccaacatggtgaaaccccatctctactaaaatacaaaaaattagctgggcgtggtggcgggcgcctgtagtcccagctactctggaggctgaggcaggagaatcgcttgaaacaaggaggcggaggttgcagtgagctgagattgctctactgcactccagcctggcaacagagcgagactccgtctcaaaaaaaaaagaaaaaaaaattcaacgttgtcaataaatatctgatggtgacgtacaaagaaaaagctagagagaatttcagtttaaagaattgtaagttctattaaggagatattttttaacacagctcaaggaaatattatccattcctggaatacagtggctctcaattggaggtgattccttcacgctgaatccttggggacacctggcagcatatttggttgtcacaaatgaatgtggaaatgtgactggtatcaattggatagaggccggactttacactaaacatcctacaattaacagagccccccgcaagaaagaattattcaccctaaactttcaacaatgctgagcttgagagactttgctgtagggacaaaaacacaagtttgagaatttgataattctctgccatcttcaagctacatggattcccataagtaacttagcaagtatgagcctcagttttctaatatggtagttgggcaaaataaaatatatcaaagaacttgtgaggattagtgaagtaaactctgtgtaaacacctaccacagcgcctggcaaaaaagtcaggaagaaaataataattacctctcgatttcccaccctcctttacatcgacttctcacttcagtttctccagactaactttttggtgatcaaccatttcatagtgatgacgaggaaagtctaaaaattctgggtttggaagtaagaaaaaatcagagcttttgtaccaccaggatcagttttatgatcttaggcaaaccaacttagtctccgtgttttagttttcttatctgtcaaaaggacaaaaagacattttcccttgcctgtcttggagatgaaaataaatgaattactaggaaaaggagcaattttcccaggagaagtgatctataaatgacttgtgctttagcagtgtatgaaagcactttgagaagtatggacattatctaaattaaaggatttaagttattttactataagttacattatttaaatataatgtatttaaatagttttttgatgtgtgctatttattttttaagttatattttaaattagagaactatctatagcattaaaatatatatagatgagtctcagattaagactataaaatttctcacataccaatacacatttcatctctgaatagtctttcttttcatattttctcagttttgtttcttcaggtagttttctttatacagtttaaataaatattttgatttttttcccctgatttactagctttagatagtatcattttattttacttttcaaaagtttaatgacatagtgacttacccaaccatatgttctctttcctttcctggagcttgtttatattggtattttaaatttgtaaagtttacaaatttcacatttaatatgtagctaaaattgtgctctagctttactataggttgattttaaaaatataagcacaataaaaacgacatttatgatttcaaaattatgtgaatatgcaaaccaaatactgaaattgaaactgtggagaaggaaacgcaatcctatggcactaaagttctaatgctcaaaagataatgtcccaagcatacacaagtagtagcttttcctttcttatgtgcttatgttttctccacacatcttcggtgaccactaactcatgttcataatcatcctctcactttctttcttgaaggtgtttttgcttttttttttttttaaattacgttgtatagctttttaatgctcattggtttcccagtaagcagactctgaaacaaagatttgtgttcaggaaattgataggacattgattggattttgttcctaaggatcaacttggtgggggataaggggagacaaagtgagattaaacaggggagcaagattgagtaaaagaaaaagctggcctgtggaacactcataacaaaggcctcaactgatttcacagggaatctcttgggtggagatgcccctttgtcattgttccagctgccacaagggagtaggcatggggtgtaggttccacccaggaggcggtgtgatcttgggcaaggtgactctcgtcaaccaggacaatattgggatggtgggtggagaggaactcagctgcaaactttcagccaccaatactcccagcagctgggggaaggcaagcttcaggcctgaaatatgtgacagagcagggaaaaattcaggccacatgtaataggatccatccagagcaatcctcaagaggtagatttctcacgagatccttgaacatttggaaaactgggtttagttttttcattatccttcactggtaagttaatgaaaagtagaaataattttcctcaaagtgtttcttcattgtctttttagtactcagtgtctgatgggaagtcaagcggccaatcagattcctgctgtgtggtgtacatgttttactttttctctctatggaagattgaggaaagtttccctatcctgggagttctgaaacttcacaggatttggagctttttaaaattctaatcagcctttgtatgtttttaataagaagatgtgccttcccttctctgaagataatctttttctaatttatttccttgtttctttcattcactatcacagttcttttcacctggaactcttgttagataaaatccagaatattgtatattttttccattaaaataatcttttcctttattattcttccctttgtcttttcttctttttgtttcctgggacattttctcaagttttatcatccagatcatcagctagatccttaggtatattcattttcctttccgttctataaagtaacattaaaaatttttattttacattatttttcttttacttctttttatatggtttctttataaacatttattgttattttaattgacaaaatttgtatatatttatcatgtacaacaagttgctttgaaattctgtatgtatacattgttgaatggctaactcctgctaattaacatatgtgttacctctcacacttaccattttttctgataagaatatctaaaatccatcctctcagcagttttcaaaaatataatacattgttattaatacatactgcatgatctcacttatatgtgaaatcaagaaaaaagttgaattcatgaaagtaaagagtaaaatggtggttaccagaggctgaggtagcggggaggtgttggccaaaggatacaaaatttcagttaggggaaatatgttcaagagatctactgtacaatttggcgactatagttaataattctcttttattttggcagcattctcttcttttatgaatacaagtgcttgcttttctcttaagtctgtgctgtagataatttctacctctgctttagtcagccatatgcttccccattctggtattttcgttcacatttggttcatatgtttggtggtctatgagtcattatttcatgaataaaaacacaactagtttaattgatataagttgtttgcataggtttactctgcagatacataggtctggttcccaaagtgactaagttacgtgtgtgtgtgtggtatatttgtgtgtgttgtgtcagtctggactaaattttatataatcataacatgtaatattatatatcaacatatataaaatatataacacatacaatatatgctgtattttggtgtttgttttgtatgttttacttgttatatataccatatattatgtttcatatgttgtatatatgctatatatatatatacataatgtgggtatatttaaatgtgtctatatgtgctttttaaagtctaaatgttccaaatggttcttttgcccccaaatgtgtcttctgttagccttaaattctcattattttaaatattttcatgaagtatatcttagacacgttttttgctcttttttgcccataagaatcctcctccccagtcccaccccttggcccaaggaaaacacttctaatctgattagtgtgaagtcaaacaatagtgaattcgtactcactagcgtgcagattgagtatgcattaaatcatacatgtccattttctctgtctccttggtacttacataaaggtggaagaggactaggtttccagtattcgccatattatgcttcatctcctctccacttccttcatctatgtgaaaagtccaagaataataaacccttgagatacatattttggggcaacatataacgttctacataggctgctcaaaactggagtttacaagagcggtgtattaagatatcaagaacttgtgcaacccttaatattatgttttggttcttatttagctgttattctttttgtgtattgccctattgaaaactgttataattgatcatacacattgagtcattcttgtcatatccaaactgaaacagagtctagaagctgggggaaaagcactcagcttataaaacattcctccaagaatgtaattctctgcaagtctgactactaaaattgcttgttgtaacccgaaaccagttttatctacagcttctgagatgacttgctgcaatgctaggactaattctgcccaccaccattgctcaccaatacgaacttgccagctccccaaacacttactagtgtcagcgaactttctcaaagaacagtatataacatatctccttttttataaaacctctagccttctctttgttctttggacctccagaatacccccagtccatgtgtatgcctcaaactgcaattgtttcttcacaaacaaaacattaaatttggagatttatctttacatatttattctgactttgaaaagacatagaaaaagagaaagtatatgagcatgcatttgatttaataaaagtctcactcctaattcctaattcctagtcatgcccattcaagcattctactatgtctgcatgaatccatttaaaacagtaaatattaatgaagaaaaaattctcatttatcaattagcacccaccaatatttattctcaaggagttatattcacgatctagattctctacatgtgccaccaaacaccccacttttaccgctcctcattctgctcaggctcctgcattcaagttctaactccacttacctttgtctctctaggagaaagtaaacacacattctaacgcaagtgagtattttttggtactgataacattgaaaaatgtccaattcaaaatataaaatttctttcacatcattttatgtcacactagtaagaaatactagaattagtaacaaattacttttcgcctgcctctattctgattgtaacttaccaatgtgtttctacttcgagattgagaagtatagcattaacacgttggaattaattccctggtttaactagaaaactgccaacaagggaagtgggacataaatagtttgataagaataaagaaaatccaaagcgttacactgcctgcaaaatgaacaggtacctgtacctgttcacaaagtgaacaggtgagcagtcatagggcactatgctggttcattgcctaagacggcacaggtaggcttgtctatgtgtatgaccgatatgtgtgtgcacatatccgatatgtgtgtgcacatcggagacctacggggaggtttgcaggaggtgttatagaaaacggttgtttcttcatcattttgccaagagctcttgtcctccaacctaactgtgtccatacacagtggagcattatttgagtaaatgactgagctctgggaaatgggtaaatgaccccaaggcagaaaggtgtaaataggcttgcctgggcttctgtgtgtgttactctgctgctgtgacaaccattgctagcataacaataagatccagggttacctttatggttgtgttgagttgttggggaaaaattagaagagaatttggatcatctattctcaggagacccgtttgaatcatcaaagcttaatgtcacttgtctctatctctttcaaccatgcattccacacaccaatttgcttaaatagtggatgcacatgccaaatctaattatcccttatctcacaaagtcattaatcattcccatccattattcattgactaccaatagctactccaatctttagtacatgcaacttcagtgcacattacaataccctgtttataagtggcatttatctctgaaacgtaccgcatggcatttttaagttagatgaaatattcctggcataaaaactggtggtgtgttttatggtgttcttctcgtaatccataaaattagtaatataaaaagaaaatgctcaagataattgtgaagctgcagataattattcatggtgatgttaattagcacagtgttgtgaaaatggtgcacaacctacacagtattcagggatcgcaaagtactttgaaaagaggttgtatattatccaaaaaaagcagaaggaaagtggtgtgagggatagattagcctagttaaaagacaaaaacaatgtgaaatttggggtaactgaagcattctctagccatttaatattctcaactgctgcatactacacaattcatattgtcccacatatactttaaccttttgatttcctctaaaatatttgaggggtacttaaatagacacaatgattaagttcaaatctcattttttttcccaaagacacttacacagtctatgggacagcagagatttgaacacagatctcttgatggcaacccagagctatttcgttaatggatttattggatgaaaccaagtttttttcagtgccttctacataacaagttactatacacagtgccattacatagcattttcagaagtctattgaaaacgctaattatttatctatctttatatctatattttcatctataacctctatttatcatctatcatctttatttatagatgagaaaattgagagtcatcaaggttatgtatttttcccaagcttcctagttaataaataggtctgccatgatcctaatcttaatttatcagattcaaactgtgatgtgcatatttccaagactaccttttgttagtttcctgtcttgctggcaagtaggaaggacttattctttctttataataaaaatgttaagtttcaaagattccatagagaaaaccttgtccaagccacttattttaaagataagaaaactgagactcagaaaaggtacttctttacacatatataattgttgtaaactttaggtaaagcacgcatttcctaactattgatcttattggtatattttctataacattatgctttcctcttgagaggctcacaattggaatgtcatacaatcttttcctcttgtattttctctctttctagttaaaatcaatacataatgtaacattgagctcaaaaccttcatcttccataaatttttatcagatttcttgtgcacaaagaatttatcttttcttggaactaatagaacatatatatgattcaattaatcttttccatttgctgtatctttttatttattctgcctcataatcactcatagtttcttaaacatgttcatatcttatcccatgagctagatgacaaagttctgtgagaaaaactcgtacacttcctgtttctacactcttcctgttgtattgccttgccatggtaagcactcaattagtatctggtgattgcttgcttaatgtttgaccaggacaaagagtagattatttagcctattttatttacaaggtacagcaagttaaatgatatgtggttttatcattaaaaagtgaaaagggaattaaggagattgaaaattcactgcaatgttctgcctgctaccatgatggtggaaagccaaaacagcaattttaccagccagcttttcctgtggtgtgtttctacaccaatgagctcagtattttaacataaactgtataaaaataactgctagtatttatacttcaaaatgtatctatttagttgagtgtgatggtgttcacctataaccccagccactcgagaggatgagttggtaggagcacttgagtccaggatttcaaggctgcaatgagctcagacagcaccactgcactcccgcctgggtgacagtgtgagagcctgtctctaaaaagaaaaatcaaagtgtctgtatttctcatatttcatcacacttttggagtactgacttgtacatagatttctgaaaacgctttgtaagctgaacataagacaaaaagaagatgatgagaaccagccttatcttcttgaaaataattacgaagctataaaaagaaacagatacaactagacaaggaaccttaagggtcggggaggggaggaaatacttggatgccctctcttccttctggtcctcttctatgtgtattgattgcctcagacaccttcagagtaatcatattgtggagagcatggatgaacatctaagagggagaaaatatcaggatattaagtaaaactaggttttcaaatgcaataaccactcactgtagcttttcggggatgatatttgcctggcaataacttttgatttaagaaaaatctttttcaccaaaacctatcccttctctgagatgggttccaatctagataaatggcaaagctattctcctgtttactcaagacccaaacctagatgttactgttgatccctttctctcccttacctactatagccaatcaatcaccaatttctgctgagtctactcccaaatatttcttgagtctttccatttctttccaatctgttactatcactgtagtctgaaccaatattatcttttacctagaccatttatttactccaaagtaatttctatcactatcgaccaccaaataagtgtggaagttaacagtgccagctttcaagtcagactgctcactggttagctaagcaatattaggcaatttttaaagctttttgtaagatgaagataataatatttaccttgttaccagcagcaaatgggtctgcagcactcaatacttgcctaactggaggaaaaaatttggctgagggccagaagtaggttgaaggcaaagggagagataaaggcaagtttgtttttttgttttgttttttgtttcttgttttggagacggggtctcactctgtcactcaggctggagtgcagtagtgcaatctctcagctcactacaatctctgtctcctgggttcaagcaattctcctgcctcagtctcccaagtagctggggctacaagcacatgccaccacacacagctaattgtgtgtgtgtgtgtgtgtgtgtgtgtgtgtgtgtgtgtgtgtgtttagtagagatggggtttcaccatgttggccaggctggtcacaaactcctgaccttaagtgatccacccacctcggcctctcaaaatgctggagttacaggtgtgagccaccgcgtccagcctaaagcaagtttaagagcaggagtgaaagtttattaaaaagttttacagcaggaatgaaagcaagtcaagtacactaggaagagggtcaagcaggcaacttgagaaatccaagttccccatctggcccttgacttgaggtttcatacattggcattcatctagggtttgcatttcttctcccttgattcttcccttggagcaggctgtccacatgcacaggggcctggtagtacttaggaggggctgcatggtcagtgtgtttactgaagttgtgcaggtgctcatttgaagcatttttcccttaccagtagagtgttccagagaaaggtcatataccagttaaactgcatcattttgtcttttactgtgcatgcctgaacccacttgctcaagtcctgagatcttatcaggaagctgctaatcaccagcttcaggtgttttctgtctattgggagactggtgttggctgtggccaattattgttttagcaagacagattaacaaccacttgatcatcacctgatggtcacctgacattccagatggggggccctctcctgtcctgctcgagtatgcctacctaggtactctagcatttctgccctcaagagtacaagactcaattatttggtataatggatgaaagtcagtcttttgtggtagtatgttctgtgagtcttggtctcttgctagctgtcagggaaaagtggctccatgggttggtgaaagtggtatccagctaggtccaagggagaagggcaggaattccactctgttgtgtttctctgatgggcattctagggtcttctaaaaggatgcctcttgaatattgagaggacagtatccctcattgaggattatttggaatttgatggcctgaaggcaagaggagacaaattgggttattgtgcttagaagacatgtacctgtaccaaaaagactaacaagtgggcctaaaaagggaaaatcccaggagaaccatttccaggtttcttcccaatttagccagttctgagtgtcttgttctcataaactggaagttcaatttaaaagttgtctgatgtggtcttgtacttttcccaattgatttaccccaaagcaacatttttcatctgagtctaaacagatttctccctgtgctgccagtaacatatctaggtcttgacaattttggaggactatggctgctaaagagtcaatttgttgttgcatagttgttaaagttttatccatgtcatcagtgttgctgggtatttcctttgagagttggctacaggccaaggaggcttttgtgattccagcaattccagtacccataccagctataatgccaagtcctatgagaaggggggttaattggatagacctcctcatcctgggaaggatggaatgcctctggattggtgctggaagagagagactcctggggatttgaagatgtcagggatacataggctatggtacaagttccagactagttagtcagaagacattggggaactgattggacacaaatatagaaggttccttggacttaaagacaaggagccttctatatttgtggagagggtagagatgtcaaaacacaataaagtctgaccctttctagcatagctagggggcatgcctaactctgtatgttcccatgccttgcctagaatttaatggatttaaagcaggcaagcagtacagttactaagagtcacagtagcagtttatactactaaagcatttagtagacctaataacctttacaattttacatttttttaaataaattccctttcacaatttgtttatgacttacataggtcacctacaacatacttggatgatttgacttgtcctaaacatccctctttgtaaacaactagtcattttactttaggacaagaatgtaccatgcaagatcacttctcatataaaatctattttctttataacctttcttaccaaaaaatctctttacctttataacctttgaattagactaaagtaattttccttctgttaagaagttatgttgctgtgcaagtactacgaagagggagaagataaggagattatctgaatactttagaagttattctccctcaagggattgctcagttagatttcttactagggcttctctgagtaaacatggactatttctaaacccttgaggtaggactatccaggttgaagttaaagatttaggtaactttcccaggagaaatagggctactagagggaaagattaattcagagtttgggtagatattaagcaggcacccatcccaaaggggtgtggggcttttagacattacctggtacttatgtaagaatagtaattggcccctaagtaatataaaggtgtgtgaatcttttcttttcgagggaagtgataccattttcccccattacccaacaggatttggaggagagttgcttagagaaggagattagcacagactaggcagctctcgaacccaaaagagaaatttataactacttcctgcctccagagttgcccttggctttgtcctgttgatggccagcaatgtctgatctgggagctagctggagctggaaccccttcagtttaaggcctttattggattggagcctggcccaggggcatttttggctcttggaacatcctttttccagtggctgagcttgtggcagagggggcaggctatgtgggggtttctcccatttggcccatttgggcaattctttttccagtggtctggtcttctgcaccaatggtagttatctagaggagtgtccttacagcaacctggagggggctggtgggcttgcagagcagccagtagttaagactccctcctgtttgtgcatttctccttctccttagccctgtcctccttattctgctctaggttttgaaagactgaggaggctaatttgagtatttcttgtataggggcactgggtcctgaggctgacttttgtaattttctaccagatcatttttaggctgaacagtattacaaaggaaaactagatttttgctttaagatttggggggatcaaaattttcccaggtttgggtatgcatcgaagggtcatgtcctgtggtgtgcagacgcaattaactatatgtgcagaaagaacaaaggagagaagaaaatgaagacatcctttctagttttcctaacatctttttcctgcacttatggcagactggagtgaacagagtgttccccattcatcctaggggttccagaatgaaccagtgcttactgggtacccataaccttggtcccatcttgttttatgaaggtacaattaaccatttgtgaagatacaacacatgagagaagagaagaggagggcaccctcccacccctgtttttccctgaatcctttgcctgtggcagatcagagtgaacagggtttcccccattcatccaaggggctctggaatgaactagtgcttgctgggtacccctaaccttggtcccatccaatttctgggaccagccttcatctctgtcctacaggtactttggtctcttatgcctgtggccttgggccagcctatatctttgttgccaagaccttacagtgactcttgttcagagcattctagaagttacaagagctggcagagccagaggtccaattagtgtgtgtcctggcaatgagccgagacacatctatgagaaagcccatttctttgttgccacacaatgcagcaaaagctgtggacatataaataacaaactgggaatgtggtcctgaaggagcacaagaccatttcagaatacagacagacaaaacaggagaataggcagtgcaggttttcaggaaacaagcagaggaaaccttgaacattacacggccttaggctttagccctaccactctcaggagcctcctgtccaagagggccattagtgcctcaggtctactctgtgcagactccaaggtccttcccaaccccatgagtcactcatcagggggagctgtgagatcagctgagaacaaagccactgtgaccaagaggaatcattctgggcattggttagtaagcaggagagtgaaaggggagaaagaatccatgtacaggggttgtacgccctcagccaaagaaagcaaggcatagaggtgtcttaccactagggaatgtgcctgagtcacagcaccaatgtatattaccagcagcaaatccatatggatctgcagcaaatcaatccttgcctccttggaggaaagaatttagccaaggggcagaagtaggttgaaggcagagggagagaccaagacaagttgtagcgggaccaaaagtttattaaaaagttttatagcaggaatgaaaggaagtcaagtacacttggaagagggccaagtaggtgacttgagagatcctagttccctgtctgtcccttgatttgaggtttcaaatactggcatggttctgggatttgtgtttcttctccatttattcttcccttggggtggcctgttcacatgctcagtggcctgctagcacttgggaggggtcacatttgcagtgcagttactgaagtagtgcaaatgctcatttgaggcatttttcccttatcaatcaactgttcctaaaggaagatcatttactggttaaactccaccgtttttcctcttggtgcacatatttgagcccggtcatccaaatcctgagagcttatcaggaagcggctgatgacagattcagctcttttctatctgctaggagaccgtcttttcctggtgtcagctgagaccaattattattttagagagacagtttaacaatcacctgaccatcacctgatggttgcctaacattcctggggcagccctctcctgctgtgctcatgtctccctaactatctactccaacaacctcactgggttgttttaaatattaatgtgttaatagacgtttgccccaaaagaagcctgctgaacaggaagatagtcagcaaatattagccattattttattaccgcacccaacaggcccagttatatcagttatatataaaatgcctgtctgattatgccttttttttttttttagacaaagtctcactctgtcactcaggctggagtgcagtagcctaatcatggctcattgaatcctcaacctcccaggctcaatcttccaactgcagcctcctgagtagctgggactacaagcataccaccacacctggctaattttcttattcttatgtaaaagtggggctcttgccatcttgcccaggctgctcacaaactcctagactcaagcgatcctcctgcctccatctcccaaagtgctggattgcaggcataagccatcatgctcagcctgactatgcccttttcaagcttaagaccattcaatgacttcctattatttttggaataaattccaaaattattgacatagctccacgtgagcattcttgattcacctctgcacacctctccagccatatctttgctattcactgtctccctcattatctgatcttgagcagcagtggcttaatttacatttcttaggcacacaaggttcatttggcctaataaagcccctgcatggcagctctcttataccttccttggactagaatcccagttatcttcccttcactcctgatgtttcttcagaaaccaacttgaagaatactttctcagggccatttactatgtgacattattatgtgaccactcaagacaagatcaaatcccatgtttatgcaatttcctaatacctagaattatagccaattagttacttatgtaattatatgtctttgtttctatcatgtaaattttattacattaagtttgtaatgaaatgggaaatgtctgtttgttaaccaaggtatcactagtgtctaaaagagtacctgacatctagttaacgtttaacaaatagttacagttatagaataaacccattataaataaatgaactaaaaaaataactgtggagttactctgattctgttctttgactttctagggattaatgctggatctacttagcaagaggacagccagggacaccttagagataattcatcctaaccactccttttacaaataaaaccagactccatgcagctataaaaagagcctttctcaaccttcctccagtcataagttcttttgtttctctatctaccataactgtgaaaggaattccatactttaactcgggcattagtggtgattagttgtccaattcataaagttgtgcattgctgaaaggggtaatccaaaggtctagaattcaaatgtcagaagtaatgagatcagtaaaatacaaggataaaaaaggcttgagaccacaaaaaagtatttcttctatctcatcttgtaaaaatcatctctgagtataaaatataacatgatgtatatttttaaagatttctcaaatgaactctaaacaggaaaagacaaaattaaggatagaaacttggatcttggttggtgctgtaaaacttgagaaagttatttatttttgttcttttccctatgagggaaaatggtatttccaatttcaagaaatccaaacatatataagctttgaaatcagaaaaattagaagccaattataccatttttaaagtattttctttgcttcctcaaatagtgagccacctaagttcaatagatcataatggcttttttttttttttttttttgagacagagtcctcgctctgtcgcccaggctggagtgcagtggcatgatcttggcttacggcaagcgcctcctcccgggttcacgccattctcctgcctcagcctcctgagtagctgggactacaggtgccctccaccacacagggctaattttcttttttttttctgtatttctaatagagaccgggtttcaccacgttagccaggatagtcttgatctcttgacctcttgattcgccctccttggcctcccaaagtgctgggattaaaggtgcaaggcaccgcgcccagcccataatacctttttaaacatgtatttaaattagatttttaccaagccatattaccaggctaagtaaaaaggtacctgtttcataattgagatcgtgtatatatttccaaaatgaccaaatacatacttttattgaaagcaacccatattttgaatacctttatcttatataattttgttctagtctacaccatcattgctactgacaaaaattatatagtactttattgtactcaagtttgttttgtcttgttttgagacagggcctcactctgttgaccaggctggaatgcaaaggtgtgatcttggctcactgcaacctctgcctccagggcttaagctatcctcttgcctcagccttccaagtagctgggactactggctaattttttgtatttttttgtatagacaggatttcaccacatcgcccagcctggtcttgaacccctaggctcaagcaatccacccgcctcagcctcccaaagggccaatattacaagcgtgagccactgcacctggccacatttcaagatattttgtattttctattcttgaacagtcttgactgaacatgaatgctctctttctgtccacccggagtagttgaaagatatttatttaaaagtgatattaatgatataaatagataaaagaagagtatcacctggataagaatttggaaataagagaaaagtttacatttgaaatgcaggttttacatgaaatatatatataatcggagttgttttttacagtgaagttcaactgttctttttgttcttgctgttccgatgctctctctcttgtttctttttgagtgtcacagacatttatattcctcttttctcaacctaacctttccctgattacaggcatttgtactaattactgtgattccacagttcaacacagacagctttgttcccactgctacagaagcacagagctgcatcaatattgagtagggggttcttgaaaataacctaagtggcattttggaatagatattcctccaatgggtaagatacctacctaaaaccacaaaatatacattcaatagcatatttttttgaaattctatagactttccaaacaacttggtttagaataaaagattcataatatgctaacacaaatgtaaatattgtaccaggtcacacctaaaggatggaaaagtctagtaagtgaaaatgcccattactcttgggctgtaagattttctaccagagaggttgcacagtaatataccctaactgttaagaatgagaaagtttgttgctgttgtattttgttttattttgtgggcatctgtaagaactagagaaaaactgtagagtcctgtgtgtgttttgtttcacctatggaatactgattctcttcgtgttaaaatgattaattcttatttgttataaaatagagaatattatataagttctggattcctgtattctcttgaaaatcatgaagttctgccaactctgggcccaatttcatctagcagctactgctgcagtatggtgcttagactcacagagggaggtggctttccagttcagccccaaccccacctctgtctttgcctaccatacactgaaacctagagtcagatggcatttatcattttttccctaatattagagttgaaaatatattttgtaaatatctgtgtttctatcaagatgggtaagattaaaaatggacccgaatagctgtatgattcaaataaaagaggtgtagtccaaaaagaaagaatatttctttgtggaaacaagggacattccacatatttaatttgtaatgttgtctgtgtgaaagactacatctttgtcatctgtgcattctactttactatacacatttatatttatttacttgccccttagtagcttagtctacagccactgtgactgtcatattcagccatggtgtaagctgacatttttttaaatgggtgtgtgaacatgtgtacacttcggaaaaagtggcaaaggatatactccctatgtcaactcattatacctagttcatgcgtttatcagttattttaactttcttttgtttatctttttcatgttatgagttttgaccatgtgcttgtgttagatttaaaaacagaaaaacaataaaataaaatgaaaaaagtaagaaaatggtttgttcagaatgctaaacacatattccctttttgttcccctctggatgcaattaatgcatacttcaatcttcatagaacctaatccaaaatgcaagggtctttataatcagccttcccaaattgatttttactcaatcaaaaccctcctctccagacatattgatttttttcattgtcccttaaacacacctgaactcggaaccatttcctccttcacgtctgtatttattctgttaagcctcttgacttccctcccagcccagaatatcttattttgttgatgcatcaaaatactcacatcattcaagtccagttcaaactccttattaatgcttcccttagacgccggaagtgatcgctgttctccctaattgcaattgcacttaaaccaactgtagcgaacagctcaatctttgttaaatatttcctcataattcctctgaggagcactaagaccctgagatattgatagtttttgtgatataaaaatttccatggcttaaaaaataatgcaaaaatgttcagaaacatttggtttaaacaaaattaaccagatttatttactgcagtatttctcagaccattagaacatgtgtagtctcctgctaatagtgaagagtggttttaatataaggaattttacaaaattttgtcagcatcaaactgacaattgtccttatgattttgtccatattttctagtagaataatgtcctgcagaagataatttgggtgatcccagttcataatatagttttatgtgtatctctttatttcaaaccagctagcaaatttctagtcactgaacttgttcttacaaatatttttacacgtcgagatccttcaacacttatgagttcatggtatgtgtgcaaaaaccacgaatagataaggaggggagtaacaatacattgtccattggctaagataccggagcagttcaaggggacagtcatcccagattcagggaaacaggaggaaacccatcaaaggatattaggtaacctctgacagtctggcaatgtttccctcttcatgacactcggtccttgcttctcctcttctgtctggaccaaatgatttcaaactcaggcttcctgtagctctccagtgtgaaagaggcttaaagagataggatcacttcaattcagggtgcagcctcatttttccctctgctgttcacatattgataggaactttacatctgtcatgtctccttttatagatgaatgtagggagggtggatgataatgcattccaatatttattcaatttcaaaatgaaagacaagttgaaaatccttcatgaggatgcaatccacggaaatatgagagctgtctacctaccatctctaacagattttggcctttgtttatttccgaagcacttatttgtcattaagataatttttgtttatgttttctcaggcatattatgattcccttaagtttccagagagccttgttctatgctctgtaaaggagaggcatatgtgggttaaataagaatttaatatatgcttaatgaatatatcacttatttgtagaatgcattcttgttcctccttgatattcttgccatgccaaaccatcacgatttctgtcatttgccaaagtatattcttactttgcacttacactgattacacctgatagcccattttgctgagtcatcctactgttctctgtgtccttacttctcatagtgttgtcaggaaaccagcagcataggcatcccctgagagtttgatagaatgcaaaattgcagctccaactccagacatagtgattcagaatacgcatttaaacaaaagtccttggcaattcttatgctcattagagttggagaagctctgttctaagtgttccctggatttttcactgtgggctgaggcacgtggtatatagacatctctctctctcttaacttcttctgttctcctgggcattgtcttcaatatttctctttctttttcctttcagcaagtgcacctgcttaggactcactaaaccattttcacaattaattttccatctaatcaaaaccctcctatccatatatctctactatcactccaaaaataaaagtttcattgaggtctgcctcccctatagttagctagctcagatggaagttgtaggctattccacttgccaggcatttttcagcccattgtttgcatttttgttccatcattttcctgaaactttttaagtcacaattacctaaaattgttgaacatattgagcattttttgaatttcagttgtctggtctctctgtcacctttgacactgttgttacgttcttccttaaaactctctttttcctcagcttctgagaaataatcctcttccgattccacagagactcagatggttctttctcatttccccacatctgtgttcccatccaatcggtattatccttccatccatgcatccatccatgcatccatccatccatctatccatccatccatccatccatccatccatccatccatccattcatcttcagctttctttttttaatctctctatacattttttataaatgatgcttctgactttcaagacttcaactaccagatccagagctactgattcctttcatcagtgaccatgccttttctcccacatgcctctctgaatgtgagatatctctccctgtcaatacaacccacactaaacttattttctccccacctcttccattctatattccttagctgggctggtagaattgaaaagtctttctcaactcctacttccttttctgtgcacatccaattatcccctgcattctgtcaattccactgtcttaacaactcttaagtctatcttgccttcctatcacatagttaccaacttaattcagaatttcttcattatttcttaccttcactgcaataatggtctcctagtaggttttctttctccttacccacagagttcttcctaatcaatttttcttacttcttacaccatgaaaaagcttcccttctcattctgtagccatctcaatgggtttgttcttgcaggtctaccaaaagcaaggaagggctcctgaggttataccaatgtaaaaggatagaaaggtgagtaattcagatgagatgtggtttctcagacaacactcccttccaacatctatgaaaatagatgaacatgaagcaaaattaaaataatagcaaatagtctgggcacaatggctcatgcctgtaatccccgaactttgggaggccaaggcaggagcattacttgattccaggagttcaagacaagcctgggcaaaatggcgagaccctgtctctacaaaattaaaaaattagccaggcatattgatatgtgtctgtggtcccagctacttgggaggctgaggtaggaggattgcttgagtccgggaggtcaaggctgcagtgagccctgattgagccactgtgcacctgcctgggccataaagcaaaaccctgtctcaaaaagtaacaagaagaagaagggtagcaaataaatagcaaaaatatagcaaaaaaagaaaatatagcagtccataaaaataaaagttcaaattgattctgaataaaaaacatgctttcaaatccatctgaagaattcctaccttagctactgatttgttatcagaaaaaacaaacactgtgaaatatttaaagaggtttattccaagctaatatgagtgaccatggcctggggaacagtctcaagagatcctgaggcctacaggtatcctgaggtggattcaaagattttctgggctgggcatggtggcttacatttgtaataccagcactttgagaagccaaggtgggcagatcacctgaggtcaggagttcgaggtcagccgggccaacatggtgaaaccctgtctctactaaaaaaaaaaaaaatacaaaaattagccgatcatggtggcacaatcccagctactctggaggctggggcaggataattgcttaaatccaggaggtggaggttacagtgagccaagattgtgccactgcactccagtctgggcgacagagtggcgccatctcaaaataataataataataataatttctgatttggaatttgttgtaagagttaagctttatctttagactggaagtctttgtctaaagacttgaagttagtaggcagaaatgctcaagttaagattgggggtgttgtgatgaccaaggtttctgttatgtagatgaagcctcaggagttgcagtccttacagagaatagatggtaaatgtgtcttttgggaacttgaaagttttcagactcttacttaatcttttctagatctgaaaaaggtctggaaagggaaggcctggccgcattaatggagattctctactgatgcaaatttcccccacaaaagacagctttgctgtcatttcaaaatatgtcaaagaaatatattttatggtaaaatattttatttccttcgggatgtgctttctgtcatttctgtcatgtgatgttatactagaatcaggttggaatttagcattttattgccacaaggattcttttttgtcagtcttaggatctctgttttaactttaatgcctgtcacttatgcctaagctccaaaagggaggggatataatgaggtgtgtccaacctcccttccagttacggctggaaattcaggttttcaggtctttctagggtccccttggccagaagtttgtcagttcagccagttggcggaactgaaaattttacttacggtttacagactttagaaataaaccccactaattgcccatcctattttgagatggttcattcatatatgaaaaactcctgttcctttacatcttgatttatacctaaaaactctgtgcaggtatgatttctgtcattccagaattctccatgcctacaagtagtgttagaaatttcctttttgcaaaactacttcttctgaaggagagtgttggaagctatcttatagtttggattcatgggctggggtttggaaaagagaattattccagggggttatgaagaatcctaaaatcttaacagagcaaaatctcccaatctatatatatgtatatgtatgtgtgtgtgtgtgtgtgtgtgtgtgtgtgtatatatatatatatatatatatatatatatagtttttttttttttttcttgagacagagtcccattctgtcacccaggctggagtgcagtggtgaaatctcggatttgccattgcattacagcctgggtgacaagagcaaaactccgtctaaaacaaaaagcaaaaaacaacaacaacaataacaaaaacaaattggccaggaacatttctgtttaggaaatttaagaccaaggaactgaactaacattgggtacttaccagagtctaagacctgttattcatgggcatttagataagttttctcatttaatgtttataacaactctattgataaggacatgttctcaatagagaaaaatgaggaaagataaatgaaaataacaatggagtacttaatgccaaaaactttatcaggcgtcgtgaggtatctattatataaagctcattttgcagatgaggaatgctgctctgagaagatgagtgagctgctcatggaaacgcagctcttaactgctaaagggaggaagtaaagctttgcctgctttacttcaaggcccgagctgttttcattataacaatctacagtctttaagataggtgaagaccattttggacgcaaatgagctaaactgcttatctatttgtgttttaatcaggtctgtctgtgaagttatcttccagctattttgtattcaccccacgatacctagcactgtgttctaccatacatgaccatcaataaatgtttgctaaattgatggatgggccttgctgtgctattaaggaacactcatcacgctacaggaattgctttgtccccacgttaacagacaactggttatgatgaacttctaaaggaaaataaaattatgcttctctgaaaacacatctaataaaatgaggatgttattatcatttggtttgtttttgagaatatcgatcttaaatacagttaaataaatagctggaagattggaaataacattaggaaaaagatcttttatgagacatgataaagaacaataattctttcatatatacatttaagtacaaattcacagaactccttctgaagaaacaattgattcactcctaagtttaagtacctattaaatatttcctagtaggaggtttcatctatatgttacatgtcagtagcattacgtcaaataagagtaactatttggacccattctttggggttgaggaatggaggtgatagttattatgcatgaagtggctgactggatggtgcacgtcgtagactgcctaatgttgatattcaaaacaatcatatgaaatatgtgttactataatcacatttagatgggaaaactgagtgaggaggaagtcaggtatgtttcctggcttacatgtctagtacatgataaagccagaatttaaatctgtatgtctgattccaaaatctttgtccactctgcttctcccatgctacctccaatagctcaaagtatgaagaaggtacagtgacgcaaatagggccttcatctaaaaagatcagagtaatagcataatggataataaaatatttacaatatcaacagggtcaggggtaagtgcatttgtagaaaaaaaaatgactggaaggaaacaccacaatgaaaacagtggtttcgttgtattatattacgttttgctattttagtaatggaaaattttaagctcatgaaaaagcaagataagtgtattttaggacaaggctttacatcagattaaagaagatttctgggagagaatcagcaagaggccatcgtgcagcctggacagagggagggaacgttccacactgctgctctaacagaacacaagcaatggcatatggcactaatttgtgaaattacactttaatttcaaacccaggttaggaagagtagtcatggctggagaacactgaagaaggcttccacctattagctcaaacagtcaggcaggtactaaactgatccagcaggcagcatgctagatgttggagatagagagttgaacaccgtcatgtacgtaaaaacagcatattgtaggagcatactttagggttgtacttctttatagatcctctgaagtggggcccttgagatatatatatatatatatatgagcaaatagaacataatagcttttctacttccttctgcattgctttttaaccttccttccttcctaatatgtgcatcctgcctcaattccctatctaccttcttgcatactggcccaatatagagaatatattaattattactttccttataatagcacctcacccatctgttttatccagaaacccagttttacattccattttcaaggtcagcgaaaaacagagaaggcctcagcattatgagtgctgccccatgagatagtaggtagaatggcccatctgttaaaacactgttcataattttaaatggaacattttaaagctcagtgaaatcatttctactctccagtacaatgaacttctattctcttacctcctggagaggttgaactgaacatggaaaatcgggcctttttggttcttgtagtgaatataaatggtgatatcaaatcaccaacttggcccaggagataatttcttgtgagtcgctgaggctggctgttcaatcttacatgttttacacataattccagaccattttgcagaaggtttcttggcttccatcttaaggatcaaaagcaagtttcctcatggtttgtgattctcatgccaaaagggtaaatgtgcaggaaggtcataagcagtagcaaagcttctctcacatctgccttgagcttgagcagtcaggcttgctaatttgacctcctattgtcatttagaatcttctgccaggagagtttttttcttttttaaagaagtgagaggcagataatttgtttaaattatttatatttaagaagtggaaggaacagggaagaaaaaagagatgtcttgattttctgaggagtatgccatggatagacacttagggcacaaaacagcagctacctggtttatgctgaaaaaaaaaacaaacatgtaaatagcaattattgtgcagcagtagccctgaggaggattctctgcatactcaatctttctaagcacccctaagtgtcttggactctccattacagaaaatgtgtttaggtctatgaatggaagagcgcacctgtgtgtgtcctgtcccagtgtttctgtgatgatgtggatgtcctatgaaaatattagtaacagatggcaatgtttctctagccttgatgttattctcatagtatttacaggtcgcatcaactggtcagatgtggctacaaagtaaagtcataatacttcaaaaattattcttcttgaaagctcatgtatatgtattctcaaaagacacactcaggcagttagaaccagtgtatttctatgtaatgacctgttctcccaaacatggttgtctcattgcccagggattaaaaggggaaatgcttctaacaatcagcaaaggcaaaaactgcaaagggatggaataaaaaaaaaaccataaagcagacataatgatttacagaggcaagcaatctgaggttatctatttgaggagccaataattacatgtatacaaataatctttggaggaatagtacaaaaatggatgtttcagaggttgacccaagtcataatatttaaaatccctagtgtaaggaggcacagagcaatataattttagaaaatcacccatccaaaatatattttaaaggattttcacctaaagatgacattccttttaccaatgatgtagactacattagttctccttccctttaggtctgaagttcagttagctcagtctcttttgtactaggtagagtttgtggctattcccttgaatagtccagatgactttgctcttaacaaggcagtcccagagtagttaacatgaaagccacgtgtgagggtgtgtgtgggagggagagaggagttggtgggaagaggaggtcatctgtgctaatggaaaataaactcaaagggcatatccagcatcacctttgtatgggaagagcatctatttggggttttcattttctgataggcagtgatagaattacaactaatataataaataaatagaactttagagagtgcaagaaaagaatcccagccctggccagtgatttgatttgctctagcacatccatctgactgagccatctggcagtgaaccagtggtatcagaacagcaatgggtgtaaccttgaggaagggttgccccttgacaaacagactggtgggaaaagtgcaggatgtggcaagactgaggatgaacaactatccaccctgcagaggatagcgacatagggagagaaatgcgtggtgcacatcactttgtcctgagtgtttggccaggccaggtatgaaaggcacttaggctggatacctaggaatgtctaacagcaggtggagcaggcaagaaaggaggccaggctctagttaagaagagattaattatggtttggagagagctgtccattcataactggcgggctacagagggcagaaatcattccccaatgggagaaattgttaagagattgagtgaactccaactatgaaggcctatcaacggacagaaggcagggcgtagagaatgttgtgatttagaagttatacagccaagtaccttctaggtacacctgtgctgtcagactattagaacaagagccaattcaaagttctattcaactttgagacttaggctgccagtattcccaccaggtcacatttggctaagacagctttacacagagaaatgaaggtcatcagcataaagacagagatgttcagagcttaaggaggaaaagtagacaatatcatatgaggacagaaagaggcacggggatgcataacactgtattaagatgaatattacaaagctgaaacaaagagtttttaaattctaatttgcatttccaaaagttatatgcacagatacttgcactgcttcatttcctctctacatgggggtctgggtggctatctggaagaaaagaaaaaagcttatcaattttttttttagtgccctattgaacacatcactgcattttaatctgggacagatggtggaaaatggcatctggttaatcaggggttcatagattatttggtgatacaacttaactgtgctgatgaagaaatgagaaattttgtctcttccctagagcagcattataaagcatccttcctggtgtttaaaattgattgtgcattctattggttaaagagtggcattttgaaaataaaattagggctgatttgcatttgtgttgaaacagttgcacaggcatttgataagaatagttcttttttcttttagaacacatttacagtttgcatttatttatattaactcaatgttttattcaacattgttttaaaagacaagacaaacatggatataattactcataaagaaaataactcttatgagtgagaatgattactatgtatttcatttgggaaaataaaacacaattttttttattaataaggacacaggcaatacttcagtaaatgtaccaaggtaattcaattttataacggacaattttaaaaggcattttgaaacattatatattattaatttttacatctagaattgtacttgtagatgccatcagaatactcgatcaatatctgtttattcagatttaagctccatgacttagttgcattacatttaatttatgtgtatttccttgattcacagtctgtagtaaattctgattgcttacacctgggcaaaatgtctttaaaattgtcaataacttccaggcagtaaaaaaaatgaattgcatgttgatggtaaaagaaaacaaactgctacatgtgatgcatgcagatttattaactaaataagtcttcattcctcctccaagtatgattgaaatttatagtcttgctagaaaactctattttccaagaaagtgtttgcaaagacatttgtacagtaattaaaatagttacttttccagtaattataatagggaacttggaaatatgcaaaataataatcttattttatttatggtatatcatattatctttgaaaagcaactcaggtgacatgatgtttaaaagttttaatctcctaaatgaaaaatatgttgctattgtagaattggtcttgtaagatggtgtcagagacaaaaatcataggaaagttcatagatttttttaatttttaagttatttcacgtaaatcatcaatggactctaggaagacataatccctcccacccctaccacacacacatacgaaaaactttacattttaaaaggccaggcaaatactactgagacagagaaatatatagtaagcacctggttgtaaatttaaccataaccatccagaaagatcagttataaaatggacattctgggctgagtatcaatggttacataaattgaactttgtcaggaaagggagggaactgagtttctaagtgggccagaggtgaaaagcaggttttgtgaaacacctagggatgctgcagttgaatagcctgcaattggaaggtagatctaagaagtaaaaatactaaaaaaaaaaaaaaaaaaaaaaaaaaaaaattaagatactactttgttataaaataccttgacgattctgtgctgatgatacatgaatcagcctcctcccatcagtacagtgaacttggtcaatgaactgactctaatgtgtgcttctttgccccaaacagtcatagggcagaaggtctaagctttagaagttgaatcctatgggagagggcatagcattcatgtaccatgacagacacatgttcattctctgccccataaggggcaaacaccattctgggtacttagggcatgaacgtgaaaaaaatagaccaaagttttgaggtgtggggtatatattacaagaagagaagagagagcacaaacatataaacaaataaataaacatgttccagatggcaataaattttataaaaataacaaaacagggtagggaggatagaaaatacaaggatgctattttagagaaggtgatcaggaaagatcttccaggcacagtgacatttgacagagatgtagaggaagtaaaccatgagctatgtggatgttctagggaagtgtactactggcaaaggaaacagcaggaacagctcggagagtttctgtttaaggaccagcaaggcaggcagcaagtgaggctgcagggctgtgggcagaaggaggatgatggaagatgatggctcagagctggtgataacaaagaggcgagatcaatcagaaccttttggccgctctaggaaacttggcttttcttttcactgaggcaagaggccactggacatttttgagtagagtgatgtgatctggtttctcttttaaatagcttattttagctactctgaggaaactgaaaagaaggaagacaacaacaagctgttgcaacaattcagaccaagggtgctaagagtttggaccacattgctaacaacagtagtgagaaatcagtgcctattctgatgtgagtcaatgggatttgctgatagactgggggtagtgtgtgataggagagagaagtgaagagaagtaatccatgacgccaagttttctgatccacataattaaaaggatggagctaccatttactgaaatggagttgataatgggaaaaaagtaaatctgaagtccatttgggggccataattattttgagatacttcttagctattcgtggacagatcaaaagatgtgacatgcttatcttgaaaaaaaaaaaaaaactaaagaatgaatgaactagaggaatatggtaagattaccagataggcctaaaaatcaccagagtttgtgaatttcctccagtggattaaaaactccaccagaaataagaacaattgagttagagcaagaaggtagggatgtttggtgaagtggttaaggtttggaaaaatacttagaaatattttatcttctaaacattataggggtagggatgttatggccaactgtgtggcttggaaaagttccttaattaattctcattgcttctactcagtacgcagttcttataaatcagagagaacatctctttcaggttgtatcaggagcattctcaaactaacactcataaatcggcaatttaggcagggaggaaaggaatattcaccgattacctgctatattccagacaccgtgcatgccgcttcacacatattatcttaattgatcttcccgacacattttcgatgtggaaactcttattttcattttagaggtgaataaaggttaaaggttaaagattcacctacttaacatagctgggcagggatagagcatggaatttgccttacctgccatcatttccatctgaagaagttgaaaagctgtctccaaatattttggtatgagatggggtacataaatacttgttaataacttgttcgactgcattatgtctagacaagaatatattaaattcggaaaagaaataattttaggagtgtaagctttatgaggatttagtccatgctgtcttatatacaggtgtattctattcattcactcacctaatattcatttggtgcttacaataggaaaggaggttttttgtttatttgtgtttgcctgtttgagatggagtctcgctctgtcacccaggctggagtgcagtggctcaacgtcagctcactgcaacatccacctccctgtttcaagcaattcttgtgcctcagcctcccgtgtaggggggactacaggtgcgcgccactatgcctgcctaatttttgtatttttggtagagacaggctttcgccaggtaggccaggctggtctcaaactcctgtcctcaagtgatccacccacctcagcctctcaaagtcctgggatcagaggcatgagccagcacgtggggctaggctaggagttatgtgctccatagttaaataagatacagttcttgttcttgagaatttcctattttatatatatagacagccagataatagcacactgtttctactttaaaggctgcactcctcttgcctgtttaatattcaactgcctataatccagggctttgcaaaaaatcattcactgcttttttgcagtgatcagttaatcaagcagagccacaaagggactcaagcaagggtagtagaaggctggcttctggaatacaggaaaagcctctgtttgccagagcccaaggttttaaatacagacaaagtcaaaggctgggaagaaagcaatgtgcgctcatagatagcatggacccaggagatcagccccagggatggagatcagatggaagccaacattgctggtctaaatagaggcagaccaagtttagaaattgaagcacagaagttcaactgtttcaaagagatttactgcagctttgaaaaacacgaactgaaaatcaggggtgagtgtggcagggcccacaagctctcaaagaaagagagggaagcgctaactgggcagcttctttggcttcttaggctttagacccttctgaagatgctgtatatctttctctatcaggacccagggaagttgggttgttccctgggaatacttactgctgcaccaggaggaagagacagctacagtgccctaagtccccagctccagtagcccttaaggatccctggtctacttcagctcctctttcgaagctgcctcactctgagtagttttttctccctctaagagaggcctattacccttgctgctgctgctggtggtggtgggggtgtcctagatttgtctagttgtttgagtttgggggctagatcttgtattggagttgaacttcaactttttttaaggggcaaggctcttgactgaaatttctttggtaaactcttgttcctagaaaaaatccagcatttggctccctttcattgaccttttcattctgtggatactaagcctcattgatctcccagctagattcacatgccttgggatattgcctggttctaggagggacagtaggtcatatcatgatagcagtggatgagcatggtgctgtgaggctggctgaagtggccctcgataaaggtcagaaacaataggcagaagggtacaccatttatacctactggtaaagtccattggtagcccatggctggacagaaaagcaatagcccctttcagaggatggaagttaaagtactagttataaaactaaagaaaatatttaggccactggaagtaatggttcattatgattattaaaacaacaatgacaacctgcaggctaaggatgtctttaagatattgtagaatgcctgagtagataaaatatgaggcaaaataaatggcagggaataaatggatctgataagtggatgacttactatccaagatgtagcataatttccacaaggctatattctaaaatatgcagttaatgccataagcacaaaagtataaaatgcactgggatctcaatatgccaaatgcactttagagtccagtgggcttgatcttgctgaggatggccatgcctcaacagattttagtctcctagaccttaggtcatttgtattatctgatagcataaaggtatgtggcatcatggaatgagctaagtaccacattggagaaatctccccggatacccaatgatccccaggacatttcattctgttcatatcccagtaccagcagaagacagagcaatctcagatgcagcctctgccaatctcgagattccttctgccagatctttatgtcatctcagaagaatagtattttttttttgtatccttgtcctagatccacttcacactgtgttaagcaaagtggctgagaaaatgcagagttatttcaggctgagacctatatcggataatcataagggctgtgtacaccataggatggaattcacttgctttatttttcaacatttaacacagtgaaagatttaaacataaattatttgattggctcactcacttacttgcaaggaagctcctgaatcactgtatgatccccatgctcccccaaccaattcctgaaacttggaaccgaagcattattttggaaacaccaatgcaacagaaatacatgctattaccctggggccagtacaccttattctgacccatgcttccctctctctaggattgctctccacggggaaatgtatcttgttctttggccattctcatgcagagacactgttccttccccatgtacctgttaggattcagaacaagaagtcacttaactctttttacgtcgaatagttaagagtacacaattattcaggaaattgtaactttgatgtatttaaatataagaagcatctgcttggaatctgacccacgtttgtagttcatgggtcaatcagaaaattaggcagggttttaaatgatgttttcactgctctgcaaggtgcaggctaaaacctttcctcttcactcataggtgggaattgaacaatgagaacacatggacacaggaaggggaacatcacattctggggactgttgtggggtggggggcggggggagggatagcattaggagatatacctaatgctaaatgacgagttaatgggtgcagcacaccagcatggcacatgtatatatatgtaactaacctgcacattgtgcacatgtaccctaaaacttaaagtataataataaaaaaataaaataaaataaaataaaaagaaagaactcacccagtgcagctcccttcttccaagtgttgactcttctccagaatttgcttgcttttgtctctcgccagtgccttcaggtggctgttttgtagtttttccagcatttatagttattttctttgggaagggcagtctgattgaagcttattcacacattttgaaggcatccctgaggaaacaggaagaaaaatttgcactgttaaccctttgccttgcgatcaaaaagtttgtaattattatatacatatcctttcttggctttgattcttttgtgatatgtgtgtcagaaaaaaaaaagaagaaataaaagaaaggcaagaagatgaatggaagaaagagataaaataaggcttttgattaatgtataatgacatatccacaattacagtatcaggcagaatagtttcctgttcctaaaagtttcccattctctgcctattcatcacttcctccctcctttcaaattcatgacaatcattcatccttctactgtctccatagttttgtcttttccagaatgtcacatatttggaattatgaagtatgtagccttttcagactgacttcttttacttagtaatatgcacttaggatttatcaatgcattttaatagcttcacagctcattttcttttagcactaaataatatttcgttgtatggatataccacactttattcatccattcatctcctgaagggcatcttggttgcttccaagttttggcaattataaatacagtgctgtaaacatctctgtgcaggtttttatgtggacatacgtttttaatttatttggataaacaccaagaagtgcaattgctggatcatacggtaagagtatatttagttttgtaagaactgtcaaaccaaatggtacagtggctgtaccattttgtgttcccaccagcaatgaatgagagtttcagttgctccacattcgtgtcagaatttagtgttatcattattttcaattttagcattctaccagatatgtagttgtatctcattgttgttttaattctcaattccctaatgacatatactattgagaatacccacaattttacaacatggtatactaccactgctgccattacttgcaaacacctagttaaaactttctatgtactaggcactatgcagagtacttttcatatattttctcataaccctacgagtcagatacaccattattatgcattttcaggaaaaaaatcctgaagttgagaagagttaagtacactgctagtaaatgttgaatctatgacgctggggtctttctgactccaaatctcatcttttaaccactacatacatttttcctcaaagtgtgatcccgaatcccatacttcaaaccaagcaggatggtgataaaaattcagaattctgaattgtaaaatattgcattagaatcttcatgctgggtgtggatctggagtgggagaaactgaaacacactcaagattaagagccattatactaccattctaggattactcgaagtccaagtagcagttttgatactttgtttctatcttgtatcatgtatttctctttgaagtatatttacaaaatccctgttatttatataaaataaattatactaaaaacattgagattatatcttaaatgtaggtgaatatatagttttctatgttccctaattaaggatgctataaaatcttttcctcatacactctaccttagagataaatttgacaacaggggaaaaaaaaaaaacaacctcgagtctttcaaatatctactatgtatcattctggtatagtctgattgtatcctcccaaaattcatattgattcagttgattcaattgaaatcataatcaccaagttgatgatattaggaggtggggtctttgagaggtgattaggtcataaaggcaaagccctgagtggaattactgttcttataaaaacactttagacaggtagcttgctccttcccacatatgaggacacagcaggtgccacctataaactagaaagtggaccctcgccagactccaaatgtgccagagacttgatcttagacttcacagcctgtagaactgtgagaaatcattttctgttttttataagccacccagtttatgacatttttgttataacagtgcatagggactaagatatactttgtgctaggtaaattgaacaaagatcataccaaatacttctagcattatgacagatttatctaactataaaagtctatttaatgtcgttttattggatggaaaaactgaatatatttgcatattttactatactatatatactatatatatgcatatatagtgtgtgtatatatatagtattgtatatatgctataccatagtataccataatatactacatatatagtatatttcacgataatttcaggctaaggaaaaagtcattattgcaggcactctatgaaaacttattaattaaaataaacagacatgtttttgttgtggcttttgatccaagacaagacattattaaggatattaacaatagaattgcctgtgttcaaatctctgctatgcttctaagtcattgtggaactttgggcaagctttagtaacaccttttaggtcttggtgtacaagattctaaatggagataaggaaagcctctacactctagaattattgaattaaaggagttagacagtgcctgattcacattatactttcaataaatgtgagctattattattttcattattattattctcaaaaacaaaaggaaattgagtaacagagtggtagagtggaaagcgtggcagaatggtagtgtgagacccaaaaatataagaatataaatgatatgtgacaaatccatagtgtagaaattgaatactctgagaatgaaaaactgaagaaatcacttttcatgggagtgggcagggatgcatggcttctttgaggaatctaaataaacttgaaaatgtttttaggtgaaaagaatgtgtatttggagtggatgtcctcagggatgtacaaatttagagactttagctctttttggtagatagggaaaccccgtttggaccctcagacacagcccactgtgtcaagacttggcaatttgaggagagatggtgtcaaggtaggtgctgtataagaaaggaatcttagacacatgaagagaagccatcctttcttgaaccccatttgcagctacaaaattgcagactgagtactacagtcttttaaacaagcctgtcactgagttcacaaaggcaagaggcattgtcacctgaagccacaaatcctgctaagagcattaattgttctctatataacataggctgtttagttctgcaatcaataagaaagagtgggctcagatcaggacctattgcttttcttcaggtaaacttggaattcaacaaatagaccacaatctacaattttctccataaggcagaatgcaggctaagttgatacatatttacaagcatggaaatgagttaatgaccttgagatgaggatctcagtgacataaacccccattctctttacaacttcttgagtttgtcttggtgtttgctaactctgaggaggtctaaaagaataaacagtgtctgcattctgctttcaatgccataaacacattttggagaggcaggagcaattttatagctgtacatacactggagagagagcatgaccctggagagctagaggtttatcatcactttaaaaaataatggttgagaaggaattgctctaagtgtagtctctgtcttttattttatattttttaatagctacctcttattgagtgtttactaagagacaagaactctattaggcactgtttaaacttttattttaaaatgaaacacagatacagcaaaccacacaaaattattataaggcaaataccatcttaaccgctacgcatgtcaaagaatgaaatcttgctagccatccagaagtctctatacattctctgtcctctctgtctccaaaaataaccaccctcttgactttcatattaatctttttttgcatttttattgtttaccatttaagtgaacatcctaaggcattataatgtcatcaattttcaaattgatatgtcttttagcttcaatatcatcaatgtgtcatctcccttgttcccacaaactcctttcccttaaaattaatctgttgacaaatatgggccacttgtggattttaccccagggtggatttgatgagtatattgatatactcatggtgccaatttacatgttcttctcttctctgcatttccagcaagtggcagcaggaaccttgatcaaactcagcttttatattgtttgcaacactataggtagcactgaatctttcatcaggaggcaaattgatgctcaacggcagttggttattttcttggtgattataaaatggtgatactctaattctatccattatttttacacattagctcaaataatttcatatgtaaggtaattcttcctttcacctacaatttggttacccaggggcataactccaaaaaggacagaactgaagtttttatgataggttttgtgataataaattggttccctatcatcctcatcaattaggatttaaatttatctgatggatcccaatgcactgtaatttttatccttattgaagtgctattttttccttcttcatccaggtggaggcttttcaaggttaacttttgattcctcttgaactagtagtctttgatacttcccatgttagttcataacaaaatgtttcagatttatctggtgtgctccttttcttatatctgtattcagcacttttctaagaaattctgttttgtttgtctgtttgtttgtttgtttgttttaacaccacaacctggttgcaagtgatagtcattgctactagggttgccaaagttagcacataaaaatacaagccacgtagtcacctacttgggacatacttatactaaaaaattattcgttgtgtatctgaaactcaaatttaattgagcaccctgcattttatttgacaattaatttatactaggtcagtcattatttttagaccgagttaatctaggtcctctgagaagcaggtgcaagtggatgtgcaagagagttattggagaaaatgcctgtgagggaataaaagagtgaatggaaaaagcaggaataaccctttgactgtgatgtaggctttactgctgtgaaggtcaatgggaagaaaggagaatagatagaaagagtctcaaactgtagttcaggtctaagaaatatttaggagggttctcaaaccaaagctgtccaacggaggattcccacaagccctatgaaggggactgcttcagtatctctgccgcctgcactcagtcattcgcctagcacaagctgtgggaagcatagcctcactgctaatgctgttgtgcattaggaatgagataataatgatatctccaaatgaaaatgtccaattcaatttcagggctattttctaaaggaacatcttctatttgcctcttatctatagtgaaaattatagttcttaaagccttggcgattagagagttagaacatctcataattactcatttacttttccaatattatacacacaacagaaaaaaaagtaactatacaaatattaccaccacccattataattattgaaaatatgttttcttgcatatgctatctcattctctccatttggttgtactaaatctacattggtagataatatagctgttatgtactctttcctacttaacactcaatttgtcttattctactatcactaaatgtgtaatccaccataattcttaggcttatgtctctccagttctggaatgttcgcagtggctcttagtgacatgaggtattggacaattgaaacatgtctggtctaaattggtatgttcgtaagcataaaatacatactggatattggaaatttactatacgatgtaaagtctcatagacaattttcatatatattagatatcaaaatgataaaacgtttagtgtgttgggataaataaaatataccattgatttaaattcttctgtttctttttactttcttcaggtggctactaaaaaatttaaaattacacacttttttttatttaatggcgatgttcctgttaattttgttttctaaaactgatttctagaagactcctcaaaaaactcccacgaggacaatattccttgggtgattgcatgttggtaacagtctttctatgaccgttataattgaaattcagttttactgaatataaaacctccggtccatattgtcttttcttgaatgtcttaaatatgttacttcatttttttctctctaagataaagtgttactgttggaaagtttaataataataatcttagttcctttttaactcaagtattcttttgccctacatgcccaagtaattctttttttcctctttcttaattttacttcgtgttgattgtactacgttaatattatcagttacactatgagatttttcagtaagtttaattgatttttttaaatttcaggattactttcttatactttttttttttttttgagacagagtcttgcactgtcacccgggagtgcaatggtgtgatctcggctcactgcaacctctgccgcctgggttcaagtgatcctcctgcctcagcctcctgagtagctgggattacaggcacctaccaccacacctggctaattttctgtatttttagtagagctggggtttcactatgttggctaggctggttttgaacttctgacctcgtgatccacccgcctcggcttcccaaagtactgggattacaggcgtgagccaccgcgcccagtcagtattgaattttttttttttttttttaaatccttgctttattctctcactcagaaactcctataacattcatggatctttttgccatctataatacatgtcacattttcttgaaacctctttctttattttttaatttctttttagtgttaaatatttttctccttctcaacttgatttcctttaaagtgttatttttgtacttatatcctcttattttccttctagattagtcttattcctactatgctgtttcttttctttctaattttttcttgagtttgatctctttttctacttctgattaatgtttttttcatgtgttgcatgatgattttcttaatgtcctttagcttattttaaaataatatgttacacttttgaaaacattttgagcatgacattttttggcaggcttattttgtcaatagcagaagttggtaaatttcctgtaaggttcaagacagtaaatattttacactgtgtaggccatatggcctgtcacaaatacttaacattgccattgtaccatgaagatagtcataagcaatatgtaaatgaatgagagtagctatgtaccaataaaactttatttctaaaaacagaaagtagactggatttggcctctgggctacaatttgccagtctctggtccataggaatttcattctatgtttccttgtagcaactttgttttgggggctaaactttacatacatggcatttgaccttgatagttttctgttgctcatttttgtataaatttagtttttttgaacttttagataggtaaaatttaagactgacttttcaacctaaaggagatccttcttctcttgttatgtaacagtaaaaaatagatatattggcttgttttcatagatttcttatatctgtttacctggaaacaggtttgtctggattttctctttcctgcatttttattatgtctattcagttcaattttgactccacttctagtagtttatcctcagtatggggtcctgttttggaaagatgcctggaagtttggtttcaagagttcacaggatctagactgcaccagccacctaagaccttgacatagacctgctaagaacaacgaaacagctgagattttatactgctttcgagctaatgagttaacccgccaggtttatggatgtcggcaaaagacatgagactgagggtcagagacaaagactttgattactcatagtataatgagtaggatgaacatgaacgtatttgtgtgagttcttcttctcctcaagtaccatgggaggggtggttaagccagatggatgcctacccacacagtagattgcagtttatagaagaggaaccctgagcttaaggaacccaaatcttttataatggggagtaagcatgcttgttttttgttccagaggaagacattatcttttttatactgaagagtaataatgcttgtcctttgctccagaggaagatactagtccttctttccaggttaattgctgcacaaatattctttaaaagatattatgaaacagggtattttcttctgataagaaatgcagaaatatgagggaccaatttcctgttgggaaaggggctccccacagggcccattttacttactgttggaatgcacaaaacctctcctagttccactcagtgttcttatgttggtccactgtagtttctagtgaatatgcattgactatttgggggttcctttcttaaatattttggaattatcacaactgtaatttgccctactgctttcttctgcattcgctcacatagacacaagggcacccacactgtgtggcttttggtgtttacggatttgcataggtatctagttatttagaagtggtgtaaatgttgtacatttggttctgatatctaactctctatctagcctaaacccatgctgtcatcacagcagcctatcttcccaaaataaccctttcaaaaaaagtatgccaagcctgattttaccttttttgaagtcctcattttgagcataaactttatttttccctaaaatacttatatttttccctaaaatacttatttctaagatcttcctaagttgcataaaaatacttgtctctcctacccctcccccatactaagtggtactaagttgttattattttaagtggaggggccagtgttttctttctttgctttctataacattctgtatcttattttcttgctatatttgtataccccatctatcagcaattccccttaccctctttccaaatatgttgtcaaaaactagcaaagcagataaacaagcttatttaatatgtgtgcagaggatgtaaagcaaaaataactatcttctgagattgagcataatcttagaaatttctattgactttatggtccttttggcagtatatatagtctagaggaatttaagctgtatttacaacaacaaatattttattcaatttcaatatttcctcagcattttgcccattatagctcttcctcctccaaatttagtatagtgtttatatattaggtaagaaataaattaggagtgatagtgcaaacataattctctccaaattctcctgtgagctctccacactggaagcttggtacttcataacacgtagtacctgctcctaagcagtagaaaattccatgcttatgtggcttttacttaatgttttagaactaagcaatatctgatgggttcttactcatatccaacatcagtagatcagatgctgatatgatgaatcttgataagatgaatcttgatattcagaggaatatcaagactatgtaattcctacatgtcaagtagagaaaagtaaaatattctgggacaacagaaagagaaaatatattttccctggatgatcctattcagtaaaataaaaaatacaagattataggagatgctaatagagcttaatattgagagggtgaataaagatttttttttcaaagagcatttcctctgaggctccccctacttaggcaaggagactgatgtagacccctacccaccaccccctgagcacacacacacagttaactccagtccccaacagaattcctctccactaagcattgatattagtagaaaagataagatgccccatatgacaattaggatgctgaacaagctattaggttggtgtaaaaaaattgcggttttgccattactttttttttttttttttgagacagaatctcactctgtcacccaggctggagtgcagtggcgccatcttggctcactgcaacctccgcctcccgggttcaagtgattctcctgcctcagcttccctagcagctgggattacagtcacgtaccaccacaccaagctaattttatttattttttttttttggtattcttagtggagacggggtttcgccatttgaccggcttggtctcgaactcctgacctcaaatgatccacttgccttgacctcccaaagtgctagggctattatatttaattgcaaaaaccacagttacatttgcaccaacctaatattagaaactaaaggcattcaattgtgcagtgagatagacactacaaagagtgaaagaagaaagtccctgtgaacttgcgatgggaaggttgtgaaaggtgttgagtcctaatagatcagttatattcgggaagatgaaaatgtgagtggatggcttctccatgtgaaaggtcaggggacccctgaagggaagaggactgcccatttgtcctgtgaggcttttgatgtcctattaactaagattaaacactcttataagtgttgctcagtaaatcaagttgctaactgaagggtgattttctagtcattgatatgtaagaactatcatatctgtaatagattcctcctcctcctctgatgcttacggtctaattgttaagtgtaacaaatgataaaatattacaaggcaaggtaagcttgaaattaattagtaatatcaagtataacttactgacagaggaatgaggaagttacacttttgactgcattctaaaattatacaaatatatagaaaaccaatggcagaagcaatatttaggcataaccagtgggatttatggtatttcatttcatgattcttatgaaggtgttaataagccaataagacttactacaccctaacatccctaacaacttcagaatgtattctcttggcgtttcccttccctttttctcctcctactctaccttgtctcttcctcttctttctctttcttctttgatttggataaagatctgtgactttagtaaatatttagatatgcaggatagaaactgagtgacttaaacatttccttactctcccaaaaagatacagatgtgtgacagattgacagacagatgaatataacaagggatatacactagcaagcaactcatcgtgtctaatagatgaaacagaattaaacaatgttcagtattgaaagatgtgttttaatgtgtcttatttcaatgtactttgcctcccctgatatcccgaaactattatttgtataatcacctgactctgcatggtgaaaggaacccaaggacttggcctcaagtttcctttggcaatagtggaagaaaaatccccagtggtagaaagtcaattggtagagacaatgccagggactctttaatgtcagcggatgctctagggctattgcaccagaatcttcgactatctcttgttttctaggggaaaattcatgggagaatttgaatctagtactaaatctttaaaaacaaattgaacattgtggaagtgttaaaaaagatgaaaatctttccttccaaaaattagtcaagatcttacagtagaattttctctttcgatttgtaaaagattttctagaatgggaaatgtgttttgtgctattatgggaattttataaggaaagaaattgagtaaccactatgaagtctaaatctaagagaaggctcagtaatatcgtacttttcaaggaataaaggaagattattttgaatcattagggaatcttgtcttggttatggaaacgagaaataccagattcaaagaaatttattcatcacaggcagacattatctcaaaaggacaaatgcgatgccaatgtttctaaatactcctccatacatagcaacctctgtcatttgtagacaaatctgattgagaaaactttattttatttctaaagagttgtgaaaatcaggaaaaaaaataccattaatatcagctcaaagagatgatggaaggttttcttttttcttttttactgtgccgacataaccaattcattaaatgacaactcttaaaaaataaagagcaaaataaagaaacacacatcccttgttgggcatctagtgggtaaacatgacaacagcaggtaaatttctcacgttctcaagttgttttggtgttacaattcagctacatgtatacagagaaaagcatacacggtaaaataatctgcattgttttactgtcttaattcctgtatatatgacacagaagggcggtggggtgaaaggaagatgtgaggttttaaatatagcaaaaaaaaaaaaaaaaagagagatttgacaacactggacctcagtaggcatgggcaatttgttcaatatcttcaggtctccagagagcaagaatgactctcaggatattgcaactctgtctgcttccaccagagatcataattgggctatgaatttttataacaggaaagtcttcctgtcaaagacagagactgacaaaaactttagttaactgatactgaaagaaactcaaaacagaatgaatagtatacatgagtatcacttatatatatagtgcctttacttctttcttcttttttactttaaaagtaaattcctgttatagtttactggttagagcttctaaaatgtagcttgtttatgaggattgctcagcatactggttttctgtccagggacatgatgtgcattttggggaattcaaaacccgattgaggtgagtagaggtcattcataaatcgaaaccaaatgatagcagaagatatgaactaaagctatttctttatctgcaaagagctaattgggcatatttcaggccaagtctctgaagacacagctcgtgaactctgtcttcttgatgctgtgctcattatagacactcaacagaggactggctaatgctagggaaatccccatcaaggtggtctttacatgacactgcagatttacctcaggaaggggagcaaagagaaggaaaatgcagtgagggtttctagcaactagctgcttgtggagtactgtttgccttgtctaatttatctgaaactgaagagtttgtctctaaagggtatcctacttcagaaaatctcaagggacatttgtctttctgacatatcagctgttagctagaccttatttcttacttggttgtttttagagtaaattttggttctttggtcctttgtctgctatttgaggtggaggattaaatactgcatagatgacctatgtatgtatagaacaacctaattttgccacagataccaaaacactataacgataatcttcaattaatccaattattatctaaatttcataacccgtcctcaattatctaccttaatatttctaggtaaagagagatgtactgcattgacttcctgtttttaaagggtaaaacagcaagagaaagaaagacattgtagatattcacaatgttgtatgtgaggaagtttttgaatggcttcagaaacccaaatgaatatattgagaaagcagcattgtgagttctgtctacatgtgaacccaaaactaggatttgaggtaatccattttcagaaagaagtgatggagtttgaattctaggaaatcttcctgaataaaatggccatgtgttgtaaagtttagatatttataacccaaaatagaaggaattttgctaggtgatctctccagttccttttcagttatgagagtctgatttcttcccatgaaaagtgtagaaaaacttcctttactgttatatgaatgttataaaatgtatgcttgtccatgaattagctgatcaaagataatacatgaaaaagtattcaaaatactctgtgaatcttttttttaaaaaactctctttaaatagatttttgtattcagaagttatgctttgtaaatacattttaaatttcagatttaaacattatcaagacaaaattgtgactatgtgcatgtaaaactagagagcactggaaaatatggtggatggtaagggccttttgcaaggtaattaacttatctattgagttttttttttttaatttctaagtacttaattgactctcccactaaaatttaaacatatacaaataatttttcattcagaagataggcatttgatttataacatcaacatatcatcacaaaaacttagagaatgagaatatcttaatgggcacctggtctaaacattttaattttaccaggtaaaaaggtggaagtggcatggcatggtggctcatgtctgtaatcccagcactctgggaggccggggtgggcggataactaggtcaggagatcgagacaatgccggctaacacggtgaaaccccgtctccactaaaaatgcaaaaaattagcttggtgtggtggcgcgcgcctgtagtcccagctacttgggaggctgaggcaggagaatgtttctttaaaaataacatcattagaaaccatacaaaacagaactgcaaatactcccttctaaggtgtaaggtattccaacatttcttgtttggacgttagaattttttcttcagtaagaaattaagttgaaaatgaagtagaacatcttacactgtaattcaagtgcaatacattaaaaaaataaaaacagtgtttaaattgggaaaatccgtttacatgtgattaagttttaatcagtgcccttaacccagatctcaacagctaaaaatgttcttagcttgacaaaataacaacccatccccaaggacaaatacttaaatcaaagaagcattttataaataaaaaaattcacgcacacatacacacacagacccccacaatacatgaaacatataataatgtttgtctttatttgtaatgaagtggattttatactgaattcagaacacagatgcaaattcaacagttgaactcaatcaaataagtaatcttatataaaaggatatctccctccagcatgtacttatcctgtgtgacagatatctctgtaataaagtaaattccttcaactcaagcagattgtccgaaatggaaacacaatgaaaggatgaatatactcaaataatcaacagaagagcaaaatataaaaatgcgaacattttctgaataatgcagatgccctccctccaaaagaattacatgtgagggaatatctatattgtcataattactggataagctgcccaatagctattacactaatgtttcattaaaaatatatatttgctttatgcttttgcaacttgcaaagttattcctagcaaaaagttatttctcctgaaacagaataaataggtctttcacaatatgcactggaatacatatttttgaaaaacaagatctccactcacctctaattctatctttctgctggtgattactgatatatttattttaaaatacatactttataggaagtatcgttacaattaatatttaggacaacattataattcgtgttttagaaactactaaggcaagaggacagctcctaccattctacaaaagtctttcagttaagaagtgactaattaatggactgagtggctcagagcagggagccagtccttagccaataaagcccaactcactgccaccccactgccccatattctctgtcctctctgctggaactgtcttgtgctgaatacatgaacacctaaatattcaactcactcctgccatttctccggtaagcaatcttccacaacctgtgcctgagacttggaggctgtttgtggtccacaggctttaggcgccctagggaaagccacgtgcactagtgcatctggatgaactgtggactttgtctatccgcggtaattcaacttcctaagagctacattgactcattgatttgtatccaggctccgggctcccaattcccacacaacgtaagctccctgcagccaggggatttggtaggtttgccgtgttgtttagtttctctcccctgcgaccctctctctgagcctcacagtgtgtttggcacgtggtaggtgctcggtaaacctactttgaatgggagagggttgtgttgaagaaaggaaaggctgggaggacttaagatttgaaggttttcctacacgtgtccaggaagaaagaaaaagaaaaaagaaatgagtatcagagtcttatcatcattacagttcttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttatta
